United States Patent
Yin et al.

(10) Patent No.: US 10,604,543 B2
(45) Date of Patent: Mar. 31, 2020

(54) SELF-ASSEMBLY OF NUCLEIC ACID NANOSTRUCTURES

(71) Applicants: President and Fellows of Harvard College, Cambridge, MA (US); Dana-Farber Cancer Institute, Inc., Boston, MA (US)

(72) Inventors: Peng Yin, Brookline, MA (US); William M. Shih, Cambridge, MA (US); Yonggang Ke, Brighton, MA (US); Luvena L. Ong, Cambridge, MA (US)

(73) Assignees: President and Fellows of Harvard College, Cambridge, MA (US); Dana-Farber Cancer Institute, Inc., Boston, MA (US)

( * ) Notice: Subject to any disclaimer, the term of this patent is extended or adjusted under 35 U.S.C. 154(b) by 355 days.

(21) Appl. No.: 14/417,390

(22) PCT Filed: Jul. 24, 2013

(86) PCT No.: PCT/US2013/051891
§ 371 (c)(1),
(2) Date: Jan. 26, 2015

(87) PCT Pub. No.: WO2014/018675
PCT Pub. Date: Jan. 30, 2014

(65) Prior Publication Data
US 2015/0218204 A1    Aug. 6, 2015

Related U.S. Application Data

(60) Provisional application No. 61/773,715, filed on Mar. 6, 2013, provisional application No. 61/675,309, filed on Jul. 24, 2012.

(51) Int. Cl.
| | | |
|---|---|---|
| *G01N 33/00* | (2006.01) | |
| *C07H 21/04* | (2006.01) | |
| *G16B 15/00* | (2019.01) | |
| *C12Q 1/68* | (2018.01) | |
| *B82Y 5/00* | (2011.01) | |
| *B82Y 30/00* | (2011.01) | |
| *B82Y 40/00* | (2011.01) | |

(52) U.S. Cl.
CPC ............... *C07H 21/04* (2013.01); *B82Y 5/00* (2013.01); *C12Q 1/68* (2013.01); *G16B 15/00* (2019.02); *B82Y 30/00* (2013.01); *B82Y 40/00* (2013.01)

(58) Field of Classification Search
None
See application file for complete search history.

(56) References Cited

U.S. PATENT DOCUMENTS

| | | | |
|---|---|---|---|
| 6,255,469 B1 | 7/2001 | Seeman et al. | |
| 6,444,650 B1 * | 9/2002 | Cech | C12Y 207/07049 514/44 A |
| 6,444,661 B1 * | 9/2002 | Barton | C07F 15/008 514/185 |
| 7,745,594 B2 | 6/2010 | Seelig et al. | |
| 7,842,793 B2 | 11/2010 | Rothemund | |
| 8,877,438 B2 | 11/2014 | Yin | |
| 9,975,916 B2 * | 5/2018 | Yin | C12N 15/10 |
| 2003/0219790 A1 | 11/2003 | Seeman et al. | |
| 2006/0078910 A1 | 4/2006 | Seeman et al. | |
| 2007/0117109 A1 | 5/2007 | Rothemund | |
| 2007/0238096 A1 | 10/2007 | Reich et al. | |
| 2008/0221315 A1 | 9/2008 | Garibotti et al. | |
| 2009/0011943 A1 * | 1/2009 | Drmanac | C12N 15/64 506/4 |
| 2009/0227774 A1 | 9/2009 | Turberfield et al. | |
| 2010/0216978 A1 | 8/2010 | Shih | |
| 2010/0291485 A1 | 11/2010 | Lapsys et al. | |
| 2012/0022244 A1 | 1/2012 | Yin et al. | |
| 2012/0251583 A1 | 10/2012 | Rothemund | |
| 2013/0065777 A1 | 3/2013 | Altug et al. | |
| 2013/0316358 A1 | 11/2013 | Navon et al. | |
| 2014/0213778 A1 | 7/2014 | Yin et al. | |
| 2015/0329584 A1 | 11/2015 | Peng et al. | |
| 2019/0002971 A1 * | 1/2019 | Koslover | G01N 33/48 |

FOREIGN PATENT DOCUMENTS

| | | |
|---|---|---|
| CN | 1390253 A | 1/2003 |
| JP | 2004-510780 A | 4/2004 |
| JP | 2008-504846 A | 2/2008 |
| WO | WO 01/36624 A1 | 5/2001 |
| WO | WO 2005/024018 A1 | 3/2005 |
| WO | WO 2006/017432 A2 | 2/2006 |
| WO | WO 2007/012807 A2 | 2/2007 |
| WO | WO 2009/093558 A1 | 7/2009 |
| WO | WO 2012/058638 A2 | 5/2012 |
| WO | WO 2013/022694 A1 | 2/2013 |
| WO | WO 2013/088098 A2 | 6/2013 |
| WO | WO 2014/018675 A1 | 1/2014 |
| WO | WO 2014/074597 A1 | 5/2014 |

OTHER PUBLICATIONS

"Oligonucleotide definition," Merriam-Webster.com; accessed Aug. 23, 2017. (Year: 2017).*
"Oligonucleotide", Wikipedia.com, accessed Feb. 17, 2019. (Year: 2019).*
Acuna et al., Fluorescence enhancement at docking sites of DNA-directed self-assembled nanoantennas. Science. Oct. 26, 2012;338(6106):506-10. doi:10.1126/science.1228638.
Aldaye et al., Assembling materials with DNA as the guide. Science. Sep. 26, 2008;321(5897):1795-9. doi: 10.1126/science.1154533.
Aldaye et al., Modular access to structurally switchable 3D discrete DNA assemblies. J Am Chem Soc. Nov. 7, 2007;129(44):13376-7. Epub Oct. 16, 2007.

(Continued)

*Primary Examiner* — Bradley L. Sisson
(74) *Attorney, Agent, or Firm* — Wolf, Greenfield & Sacks, P.C.

(57) ABSTRACT

The invention involves the synthesis of nucleic acid structures of controlled size and shape and comprised of a plurality of oligonucleotides. The structures are formed, at least in part, by the self-assembly of single-stranded oligonucleotides. The location of each oligonucleotide in the resultant structure is known. Accordingly, the structures may be modified with specificity.

19 Claims, 78 Drawing Sheets

Specification includes a Sequence Listing.

(56) References Cited

OTHER PUBLICATIONS

Aldaye et al., Sequential self-assembly of a DNA hexagon as a template for the organization of gold nanoparticles. Angew Chem Int Ed Engl. Mar. 27, 2006;45(14):2204-9.

Andersen et al., Self-assembly of a nanoscale DNA box with a controllable lid. Nature. May 7, 2009;459(7243):73-6. doi:10.1038/nature07971.

Barish et al., An information-bearing seed for nucleating algorithmic self-assembly. Proc Natl Acad Sci U S A. Apr. 14, 2009;106(15):6054-9. doi: 10.1073/pnas.0808736106. Epub Mar. 24, 2009.

Bath et al., DNA nanomachines. Nat Nanotechnol. May 2007;2(5):275-84. doi:10.1038/nnano.2007.104.

Berardi et al., Mitochondrial uncoupling protein 2 structure determined by NMR molecular fragment searching. Nature. Jul. 24, 2011;476(7358):109-13. doi: 10.1038/nature10257.

Bhatia et al., Icosahedral DNA nanocapsules by modular assembly. Angew Chem Int Ed Engl. 2009;48(23):4134-7.doi:10.1002/anie.200806000.

Chen et al., DNA-directed assembly of single-wall carbon nanotubes. J Am Chem Soc. Jul. 18, 2007;129(28):8696-7. Epub Jun. 23, 2007.

Chen et al., Invadable self-assembly: combining robustness with efficiency. Proceeding SODA '04 Proceedings of the fifteenth annual ACM-SIAM symposium on Discrete algorithms. 2004:890-9.

Chen et al., Synthesis from DNA of a molecule with the connectivity of a cube. Nature. Apr. 18, 1991;350(6319):631-3.

Choi et al., Programmable in situ amplification for multiplexed imaging of mRNA expression. Nat Biotechnol. Nov. 2010;28(11):1208-12.doi: 10.1038/nbt.1692. Epub Oct. 31, 2010.

Chworos et al., Building programmable jigsaw puzzles with RNA. Science. Dec. 17, 2004;306(5704):2068-72.

Delebecque et al., Organization of intracellular reactions with rationally designed RNA assemblies. Science. Jul. 22, 2011;333(6041):470-4. doi: 10.1126/science.1206938. Epub Jun. 23, 2011.

Dietz et al., Folding DNA into twisted and curved nanoscale shapes. Science. Aug. 7, 2009;325(5941):725-30. doi: 10.1126/science.1174251.

Douglas et al., A logic-gated nanorobot for targeted transport of molecular payloads. Science. Feb. 17, 2012;335(6070):831-4. doi:10.1126/science.1214081.

Douglas et al., DNA-nanotube-induced alignment of membrane proteins for NMR structure determination. Proc Natl Acad Sci U S A. Apr. 17, 2007;104(16):6644-8. Epub Apr. 2, 2007.

Douglas et al., Rapid prototyping of 3D DNA-origami shapes with caDNAno. Nucleic Acids Res. Aug. 2009;37(15):5001-6. doi: 10.1093/nar/gkp436. Epub Jun. 16, 2009.

Douglas et al., Self-assembly of DNA into nanoscale three-dimensional shapes. Nature. May 21, 2009;459(7245):414-8.doi: 10.1038/nature08016.

Erben et al., A self-assembled DNA bipyramid. J Am Chem Soc. Jun. 6, 2007;129(22):6992-3. Epub May 15, 2007.

Feldkamp et al., Rational design of DNA nanoarchitectures. Angew Chem Int Ed Engl. Mar. 13, 2006;45(12):1856-76.

Fu et al., DNA double-crossover molecules. Biochemistry. Apr. 6, 1993;32(13):3211-20.

Fu et al., Interenzyme substrate diffusion for an enzyme cascade organized on spatially addressable DNA nanostructures. J Am Chem Soc. Mar. 28, 2012;134(12):5516-9. doi:10.1021/ja300897h. Epub Mar. 16, 2012.

Geary et al., A single-stranded architecture for cotranscriptional folding of RNA nanostructures. Science. Aug. 15, 2014;345(6198):799-804. doi: 10.1126/science.1253920.

Goodman et al., Rapid chiral assembly of rigid DNA building blocks for molecular nanofabrication. Science. Dec. 9, 2005;310(5754):1661-5.

Goodman et al., Reconfigurable, braced, three-dimensional DNA nanostructures. Nat Nanotechnol. Feb. 2008;3(2):93-6. doi: 10.1038/nnano 2008.3. Epub Feb. 3, 2008.

Han et al., DNA gridiron nanostructures based on four-arm junctions. Science. Mar. 22, 2013;339(6126):1412-5. doi: 10.1126/science.1232252.

Han et al., DNA origami with complex curvatures in three-dimensional space. Science. Apr. 15, 2011;332(6027):342-6. doi:10.1126/science.1202998.

Han et al., Folding and cutting DNA into reconfigurable topological nanostructures. Nat Nanotechnol. Oct. 2010;5(10):712-7. doi:10.1038/nnano 2010.193. Epub Oct. 3, 2010.

Hansma et al., DNA binding to mica correlates with cationic radius:assay by atomic force microscopy. Biophys J. Apr. 1996;70(4):1933-9.

He et al., Hierarchical self-assembly of DNA into symmetric supramolecular polyhedra. Nature. Mar. 13, 2008;452(7184):198-201. doi: 10.1038/nature06597.

Hell, Far-field optical nanoscopy. Science. May 25, 2007;316(5828):1153-8.

Huang et al., Three-dimensional super-resolution imaging by stochastic optical reconstruction microscopy. Science. Feb. 8, 2008;319(5864):810-3. doi: 10.1126/science.1153529. Epub Jan. 3, 2008.

Iinuma et al., Polyhedra self-assembled from DNA tripods and characterized with 3D DNA-Paint. Science. Apr. 4, 2014;344(6179):65-9. doi: 10.1126/science.1250944. Epub Mar. 13, 2014.

Jungmann et al., Multiplexed 3D cellular super-resolution imaging with DNA-Paint and Exchange-Paint. Nat Methods. Mar. 2014;11(3):313-8. doi: 10.1038/nmeth.2835. Epub Feb. 2, 2014.

Jungmann et al., Single-molecule kinetics and super-resolution microscopy by fluorescence imaging of transient binding on DNA origami. Nano Lett. Nov. 10, 2010;10(11):4756-61. doi:10.1021/nl103427w.

Kao et al., Tracking of single fluorescent particles in three dimensions: use of cylindrical optics to encode particle position. Biophys J. Sep. 1994;67(3):1291-300.

Ke et al., Multilayer DNA origami packed on a square lattice. J Am Chem Soc. Nov. 4, 2009;131(43):15903-8. doi:10.1021/ja906381y.

Ke et al., Multilayer DNA origami packed on hexagonal and hybrid lattices. J Am Chem Soc. Jan. 25, 2012;134(3):1770-4. doi:10.1021/ja209719k. Epub Jan. 13, 2012.

Ke et al., Scaffolded DNA origami of a DNA tetrahedron molecular container. Nano Lett. Jun. 2009;9(6):2445-7. doi:10.1021/nl901165f.

Ke et al., Three-dimensional structures self-assembled from DNA bricks. Science. Nov. 30, 2012;338(6111):1177-83. doi: 10.1126/science.1227268.

Ke, Designer three-dimensional DNA architectures. Curr Opin Struct Biol. Aug. 2014;27:122-8. doi: 10.1016/j.sbi.2014.07.010. Epub Aug. 11, 2014.

Killops et al., Robust, efficient, and orthogonal synthesis of dendrimers via thiol-ene "click" chemistry. J Am Chem Soc. Apr. 16, 2008;130(15):5062-4. doi: 10.1021/ja8006325. Epub Mar. 20, 2008.

Kuzuya et al., DNA origami: fold, stick, and beyond. Nanoscale. Mar. 2010;2(3):310-22. doi: 10.1039/b9nr00246d. Epub Nov. 24, 2009.

Kuzuya et al., Six-helix and eight-helix DNA nanotubes assembled from half-tubes. Nano Lett. Jun. 2007;7(6):1757-63. Epub May 15, 2007.

Kuzyk et al., DNA-based self-assembly of chiral plasmonic nanostructures with tailored optical response. Nature. Mar. 14, 2012;483(7389):311-4. doi:10.1038/nature10889.

Langecker et al., Synthetic lipid membrane channels formed by designed DNA nanostructures. Science. Nov. 16, 2012;338(6109):932-6. doi: 10.1126/science.1225624.

Le et al., DNA-Templated Self-Assembly of Metallic Nanocomponent Arrays on a Surface. Nano Lett. 2004;4(12):2343-7.

Leontis et al., Self-assembled RNA nanostructures. Science. Aug. 15, 2014;345(6198):732-3. doi:10.1126/science.1257989.

Li et al., Nucleic acid-based nanoengineering: novel structures for biomedical applications. Interface Focus. Oct. 6, 2011;1(5):702-24. doi: 10.1098/rsfs.2011.0040. Epub Jun. 28, 2011.

(56) References Cited

OTHER PUBLICATIONS

Li et al., Single-chain antibodies against DNA aptamers for use as adapter molecules on DNA tile arrays in nanoscale materials organization. Org Biomol Chem. Sep. 21, 2006;4(18):3420-6. Epub Jul. 28, 2006.

Liedl et al., Self-assembly of three-dimensional prestressed tensegrity structures from DNA. Nat Nanotechnol. Jul. 2010;5(7):520-4. doi: 10.1038/nnano 2010.107. Epub Jun. 20, 2010.

Lin et al., DNA tile based self-assembly: building complex nanoarchitectures. Chemphyschem. Aug. 11, 2006;7(8):1641-7.

Lin et al., Mirror image DNA nanostructures for chiral supramolecular assemblies. Nano Lett. Jan. 2009;9(1):433-6. doi:10.1021/nl803328v.

Lin et al., Submicrometre geometrically encoded fluorescent barcodes self-assembled from DNA. Nat Chem. 2012;4:832-9.

Linko et al., The enabled state of DNA nanotechnology. Curr Opin Biotechnol. Aug. 2013;24(4):555-61. doi: 10.1016/j.copbio.2013.02.001. Epub Apr. 6, 2013.

Liu et al., Approaching the limit: can one DNA oligonucleotide assemble into large nanostructures? Angew Chem Int Ed Engl. Mar. 13, 2006;45(12):1942-5.

Liu et al., Crystalline two-dimensional DNA-origami arrays. Angew Chem Int Ed Engl. Jan. 3, 2011;50(1):278-81. doi:10.1002/anie.201005911.

Liu et al., DNA nanotubes self-assembled from triple-crossover tiles as templates for conductive nanowires. Proc Natl Acad Sci U S A. Jan. 20, 2004;101(3):717-22. Epub Jan. 6, 2004.

Liu et al., Tensegrity: construction of rigid DNA triangles with flexible four-arm DNA junctions. J Am Chem Soc. Mar. 3, 2004;126(8):2324-5.

Liu et al., Three-dimensional plasmon rulers. Science. Jun. 17, 2011;332(6036):1407-10. doi:10.1126/science.1199958.

Mathieu et al., Six-helix bundles designed from DNA. Nano Lett. Apr. 2005;5(4):661-5.

Melosh et al., Ultrahigh-density nanowire lattices and circuits. Science. Apr. 4, 2003;300(5616):112-5. Epub Mar. 13, 2003.

Mitchell et al., Self-assembly of chiral DNA nanotubes. J Am Chem Soc. Dec. 22, 2004;126(50):16342-3.

Nie et al., Self-assembly of DNA nanoprisms with only two component strands. Chem Commun (Camb). Apr. 7, 2013;49(27):2807-9. doi:10.1039/c3cc39177a.

O'Neill et al., Sturdier DNA nanotubes via ligation. Nano Lett. Jul. 2006;6(7):1379-83.

Park et al., Finite-size, fully addressable DNA tile lattices formed by hierarchical assembly procedures. Angew Chem Int Ed Engl. Jan. 23, 2006;45(5):735-9. Erratum in: Angew Chem Int Ed Engl. Oct. 13, 2006;45(40):6607.

Park et al., Programmable DNA self-assemblies for nanoscale organization of ligands and proteins. Nano Lett. Apr. 2005;5(4):729-33.

Park et al., Three-helix bundle DNA tiles self-assemble into 2D lattice or 1D templates for silver nanowires. Nano Lett. Apr. 2005;5(4):693-6.

PIELES et al., Psoralen covalently linked to oligodeoxyribonucleotides: synthesis, sequence specific recognition of DNA and photo-cross-linking to pyrimidine residues of DNA. Nucleic Acids Res. Jan. 11, 1989;17(1):285-99.

Qi et al., A three-dimensional optical photonic crystal with designed point defects. Nature. Jun. 3, 2004;429(6991):538-42.

Qian et al., Scaling up digital circuit computation with DNA strand displacement cascades. Science. Jun. 3, 2011;332(6034):1196-201. doi:10.1126/science.1200520.

Rajendran et al., Photo-cross-linking-assisted thermal stability of DNA origami structures and its application for higher-temperature self-assembly. J Am Chem Soc. Sep. 21, 2011;133(37):14488-91. doi:10.1021/ja204546h. Epub Aug. 29, 2011.

Reif et al., Compact error-resilient computational DNA tiling assemblies. Proceeding DNA'04 Proceedings of the 10th international conference on DNA computing. 2004:293-307.

Reif et al., Complexity of graph self-assembly in accretive systems and self-destructible systems. Journal Theoretical Computer Science. 2011;412(17):1592-605.

Rothemund et al., Algorithmic Self-Assembly of DNA Sierpinski Triangles. PLoS Biology. 2004. 2004;2(12):e424. doi:10.1371/journal.pbio.0020424.

Rothemund et al., Design and characterization of programmable DNA nanotubes. J Am Chem Soc. Dec. 22, 2004;126(50):16344-52. Erratum in: J Am Chem Soc. Feb. 20, 2013;135(7):2864.

Rothemund et al., The program-size complexity of self-assembled squares. Extended Abstract. Proceeding STOC '00 Proceedings of the thirty-second annual ACM symposium on Theory of computing. ACM 2000:459-68.

Rothemund, Folding DNA to create nanoscale shapes and patterns. Nature. Mar. 16, 2006;440(7082):297-302.

Sahu et al., A self-assembly model of time-dependent glue strength. DNA'05 Proceedings of the 11th international conference on DNA Computing. 2005:290-304.

Schmied et al., DNA origami nanopillars as standards for three-dimensional superresolution microscopy. Nano Lett. Feb. 13, 2013;13(2):781-5. doi: 10.1021/nl304492y. Epub Feb. 5, 2013.

Schulman et al., Synthesis of crystals with a programmable kinetic barrier to nucleation. Proc Natl Acad Sci U S A. Sep. 25, 2007;104(39):15236-41. Epub Sep. 19, 2007.

Schweller et al., Multiplexed in situ immunofluorescence using dynamic DNA complexes. Angew Chem Int Ed Engl. Sep. 10, 2012;51(37):9292-6. doi: 10.1002/anie.201204304. Epub Aug. 15, 2012.

Seelig et al., Enzyme-free nucleic acid logic circuits. Science. Dec. 8, 2006;314(5805):1585-8.

Seeman et al., Nucleic acid nanostructures: Bottom-up control of geometry on the nanoscale. Rep. Prog. Phys, 2005, 68: 237-70.

Seeman, De novo design of sequences for nucleic acid structural engineering. J Biomol Struct Dyn. Dec. 1990;8(3):573-81.

Seeman, DNA in a material world. Nature. Jan. 23, 2003;421(6921):427-31.

Seeman, Nanomaterials based on DNA. Annu Rev Biochem. 2010;79:65-87. doi:10.1146/annurev-biochem-060308-102244.

Seeman, Nucleic acid junctions and lattices. J Theor Biol. Nov. 21, 1982;99(2):237-47.

Sekulić et al., A direct linkage between the phosphoinositide 3-kinase-AKT signaling pathway and the mammalian target of rapamycin in mitogen-stimulated and transformed cells. Cancer Res. Jul. 1, 2000;60(13):3504-13.

Sharma et al., Control of self-assembly of DNA tubules through integration of gold nanoparticles. Science. Jan. 2, 2009;323(5910):112-6. doi: 10.1126/science.1165831.

Sharma et al., DNA-tile-directed self-assembly of quantum dots into two-dimensional nanopatterns. Angew Chem Int Ed Engl. 2008;47(28):5157-9. doi:10.1002/anie.200801485.

Sharma et al., Toward reliable gold nanoparticle patterning on self-assembled DNA nanoscaffold. J Am Chem Soc. Jun. 25, 2008;130(25):7820-1. doi: 10.1021/ja802853r. Epub May 30, 2008.

Sharonov et al., Wide-field subdiffraction imaging by accumulated binding of diffusing probes. Proc Natl Acad Sci U S A. Dec. 12, 2006;103(50):18911-6. Epub Dec. 1, 2006.

Sherman et al., A Precisely Controlled DNA Biped Walking Device. Nano Letters. 2004;4(7):1203-7.

Shih et al., A 1.7-kilobase single-stranded DNA that folds into a nanoscale octahedron. Nature. Feb. 12, 2004;427(6975):618-21.

Shih et al., Knitting complex weaves with DNA origami. Curr Opin Struct Biol. Jun. 2010;20(3):276-82. doi: 10.1016/j.sbi.2010.03.009. Epub Apr. 22, 2010.

Shtengel et al., Interferometric fluorescent super-resolution microscopy resolves 3D cellular ultrastructure. Proc Natl Acad Sci U S A. Mar. 3, 2009;106(9):3125-30. doi:10.1073/pnas.0813131106. Epub Feb. 6, 2009.

Smith et al., A structurally variable hinged tetrahedron framework from DNA origami. J Nucleic Acids. 2011;2011:360954. doi: 10.4061/2011/360954. Epub Sep. 18, 2011.

Tang et al., Evolution of block copolymer lithography to highly ordered square arrays. Science. Oct. 17, 2008;322(5900):429-32. doi: 10.1126/science.1162950. Epub Sep. 25, 2008.

(56) References Cited

OTHER PUBLICATIONS

Tavakkoli et al., Templating three-dimensional self-assembled structures in bilayer block copolymer films. Science. Jun. 8, 2012;336(6086):1294-8. doi: 10.1126/science.1218437.
Tørring et al., DNA rigami: A quantum leap fr self-assembly f cmplex structures. Chem Sc Rev. Dec. 2011;40(12):5636-46. di: 10.1039/c1cs15057j. Epub May 19, 2011.
Venkataraman et al., Selective cell death mediated by small conditional RNAs. Proc Natl Acad Sci U S A. Sep. 28, 2010;107(39):16777-82. doi: 10.1073/pnas.1006377107. Epub Sep. 7, 2010. Retraction in: Dirks RM, Ueda CT, Pierce NA. Proc Natl Acad Sci U S A. Jan. 2, 2013;110(1):384.
Wei et al., Complex shapes self-assembled from single-stranded DNA tiles. Nature. May 30, 2012;485(7400):623-6. doi: 10.1038/nature11075.
Wei et al., Uniquimer: Software of De Novo DNA Sequence Generation for Dna Self-Assembly—An Introduction and the Related Applications in DNA Self-Assembly. J Comput Theor Nanosci. 2007;4(1):133-41.
Winfree et al., Design and self-assembly of two-dimensional DNA crystals. Nature. Aug. 6, 1998;394(6693):539-44.
Winfree, Algorithmic Self-Assembly of DNA. Doctoral Thesis. California Institute of Technology. Mar. 1998.
Woo et al., Programmable molecular recognition based on the geometry of DNA nanostructures. Nat Chem. Jul. 10, 2011;3(8):620-7. doi: 10.1038/nchem.1070. Erratum in: Nat Chem. Oct. 2011;3(10):829. Nat Chem. 2011;3(8):following 627.
Yan et al., A robust DNA mechanical device controlled by hybridization topology. Nature. Jan. 3, 2002;415(6867):62-5.
Yan et al., Directed nucleation assembly of DNA tile complexes for barcode-patterned lattices. Proc Natl Acad Sci U S A. Jul. 8, 2003;100(14):8103-8. Epub Jun. 23, 2003.
Yan et al., DNA-templated self-assembly of protein arrays and highly conductive nanowires. Science. Sep. 26, 2003;301(5641):1882-4.
Yang et al., Artificially expanded genetic information system: a new base pair with an alternative hydrogen bonding pattern. Nucleic Acids Res. 2006;34(21):6095-101. Epub Oct. 29, 2006.
Yang et al., Metal-nucleic acid cages. Nat Chem. Aug. 2009;1(5):390-6. doi: 10.1038/nchem.290.
Yevdokimov et al., Nanoconstructions based on double-stranded nucleic acids. Int J Biol Macromol. Jul. 2005;36(1-2):103-15.
Yin et al., A unidirectional DNA walker that moves autonomously along a track. Angew Chem Int Ed Engl. Sep. 20, 2004;43(37):4906-11.
Yin et al., Designs of autonomous unidirectional walking DNA devices. Proceeding DNA'04 Proceedings of the 10th international conference on DNA computing. 2004:410-25.
Yin et al., Programming biomolecular self-assembly pathways. Nature. Jan. 17, 2008;451(7176):318-22. doi: 10.1038/nature06451.
Yin et al., Programming DNA tube circumferences. Science. Aug. 8, 2008;321(5890):824-6.
Yin et al., Theoretical and practical advances in genome halving. Bioinformatics. Apr. 1, 2005;21(7):869-79. Epub Oct. 28, 2004.
Yurke et al., A DNA-fueled molecular machine made of DNA. Nature. Aug. 10, 2000;406(6796):605-8.
Zhang et al., Conformational flexibility facilitates self-assembly of complex DNA nanostructures. Proc Natl Acad Sci U S A. Aug. 5, 2008;105(31):10665-9. doi:10.1073/pnas.0803841105. Epub Jul. 30, 2008.
Zhang et al., Construction of a DNA-Truncated Octahedron. J Am Chem Soc 1994;116(5):1661-9.
Zhang et al., Symmetry controls the face geometry of DNA polyhedra. J Am Chem Soc. Feb. 4, 2009;131(4):1413-5. doi:10.1021/ja809666h.
Zhao et al., Organizing DNA origami tiles into larger structures using preformed scaffold frames. Nano Lett. Jul. 13, 2011;11(7):2997-3002. doi:10.1021/nl201603a. Epub Jun. 23, 2011.
Zheng et al., From molecular to macroscopic via the rational design of a self-assembled 3D DNA crystal. Nature. Sep. 3, 2009;461(7260):74-7. doi:10.1038/nature08274.
Zimmermann et al., Self-assembly of a DNA dodecahedron from 20 trisoligonucleotides with C(3h) linkers. Angew Chem Int Ed Engl. 2008;47(19):3626-30. doi: 10.1002/anie.200702682.
Alexander et al., On Types of Knotted Curves. Annals of Mathematics 1926-1927, 28(¼): 562-586.
Alexander, Topical Invariants of Knots and Links. Transations of the American Mathematical Society 1928, 30(2): 275-306.
Anthony, MIT and Harvard engineers create graphene electronics with DNA based lithography. Extremetech.com. Apr. 10, 2013. http://www.extremetech.com/computing/153046-mit-and-harvard-engineers-create-graphene-electronics-with-dna-based-lithography.
Bertrand et al., Flexibility of the B-DNA backbone: effects of local and neighbouring sequences on pyrimidine-purine steps. Nucleic Acids Res. Mar. 1, 1998;26(5):1261-7.
Cataldo et al., DNA degradation with ozone. Int J Biol Macromol. May 30, 2006;38(3-5):248-54. Epub Apr. 17, 2006.
Dimitrakakis et al., Top-down patterning of zeolitic imidazolate framework composite thin films by deep X-ray lithography. Chem Commun (Camb). Aug. 4, 2012;48(60):7483-5. doi: 10.1039/c2cc33292b. Epub Jun. 22, 2012.
Fratini et al., Reversible bending and helix geometry in a B-DNA dodecamer: CGCGAATTBrCGCG. J Biol Chem. Dec. 25, 1982;257(24):14686-707.
Han et al., Unidirectional scaffold-strand arrangement in DNA origami. Angew Chem Int Ed Engl. Aug. 19, 2013;52(34):9031-4. doi: 10.1002/anie.201302177. Epub Jul. 14, 2013.
Horiya et al., RNA LEGO: magnesium-dependent formation of specific RNA assemblies through kissing interactions. Chem Biol. Jul. 2003;10(7):645-54.
Jin et al., Metallized DNA nanolithography for encoding and transferring spatial information for graphene patterning. Nat Commun. 2013;4:1663. doi: 10.1038/ncomms2690.
Jones et al., Nanomaterials. Programmable materials and the nature of the DNA bond. Science. Feb. 20, 2015;347(6224):1260901. doi:10.1126/science.1260901.
Jungmann et al., DNA origami-based nanoribbons: assembly, length distribution, and twist. Nanotechnology. Jul. 8, 2011;22(27):275301. doi: 10.1088/0957-4484/22/27/275301. Epub May 20, 2011.
Ke et al., A study of DNA tube formation mechanisms using 4-, 8-, and 12-helix DNA nanostructures. J Am Chem Soc. Apr. 5, 2006;128(13):4414-21.
Ke et al., DNA brick crystals with prescribed depths. Nat Chem. Nov. 2014;6(11):994-1002. doi: 10.1038/nchem.2083. Epub Oct. 19, 2014.
Lee et al., Rate and molecular spectrum of spontaneous mutations in the bacterium *Escherichia coli* as determined by whole-genome sequencing. Proc Natl Acad Sci U S A. Oct. 9, 2012;109(41):E2774-83. doi: 10.1073/pnas.1210309109. Epub Sep. 18, 2012.
Li et al., A replicable tetrahedral nanostructure self-assembled from a single DNA strand. J Am Chem Soc. Sep. 16, 2009;131(36):13093-8. doi: 10.1021/ja903768f.
Lin et al., In vivo cloning of artificial DNA nanostructures. Proc Natl Acad Sci U S A. Nov. 18, 2008;105(46):17626-31. doi: 10.1073/pnas.0805416105. Epub Oct. 16, 2008.
Ma et al., Biotemplated nanostructures: directed assembly of electronic and optical materials using nanoscale complementarity. Journal of Materials Chemistry. 2008;18(9):954-64.
Mansfield, Are there knots in proteins? Nat Struct Biol. Apr. 1994;1(4):213-4.
Mao et al, Designed Two-Dimensional DNA Holliday Junction Arrays Visualized by Atomic Force Microscopy. J. Am. Chem. Soc., 1999, 121 (23), pp. 5437-5443.
Marchi et al, Toward larger DNA origami. Nano Lett. Oct. 8, 2014;14(10):5740-7. doi: 10.1021/nl502626s. Epub Sep. 8, 2014.
Matsui et al., Focused ion beam applications to solid state devices. Nanotechnology 1996, 7(3):247.
Monson et al., DNA-Templated Constructed of Copper Nanowires. Nano Letters. 2003;3(2):359-63. Epub Feb. 14, 2003.
Petty et al., DNA-templated Ag nanocluster formation. J Am Chem Soc. Apr. 28, 2004;126(16):5207-12.

(56) References Cited

OTHER PUBLICATIONS

Piner et al,. "Dip-Pen" nanolithography. Science. Jan. 29, 1999;283(5402):661-3.

Pinheiro et al., Challenges and opportunities for structural DNA nanotechnology. Nat Nanotechnol. Nov. 6, 2011;6(12):763-72. doi:10.1038/nnano.2011.187.

Rajesh et al,. Carbon Nanotubes Generated from Template Carbonization of Polyphenyl Acetylene as the Support for Electrooxidation of Methanol. J. Phys. Chem. B, 2003, 107 (12), pp. 2701-2708.

Randolph et al., Focused, Nanoscale Electron-Beam-Induced Deposition and Etching. Critical Reviews in Solid State and Material Sciences, 2006, 31(3):55-89.

Ravanat et al., Direct and indirect effects of UV radiation on DNA and its components. J Photochem Photobiol B. Oct. 2001;63(1-3):88-102.

Scheible et al., A Compact DNA Cube with Side Length 10 nm. Small. Oct. 21, 2015;11(39):5200-5. doi: 10.1002/smll.201501370. Epub Aug. 21, 2015.

Seeman et al., The design and engineering of nucleic acid nanoscale assemblies. Curr Opin Struct Biol. Aug. 1996;6(4):519-26.

Surwade et al., Molecular lithography through DNA-mediated etching and masking of SiO2. J Am Chem Soc. Aug. 10, 2011;133(31):11868-71. doi: 10.1021/ja2038886. Epub Jul. 19, 2011.

Surwade et al., Nanoscale growth and patterning of inorganic oxides using DNA nanostructure templates. J Am Chem Soc. May 8, 2013;135(18):6778-81. doi: 10.1021/ja401785h. Epub Apr. 25, 2013.

Takusagawa et al., A Real Knot in Protein. J. Am. Chem. Soc., 1996, 118 (37), pp. 8945-8946.

Taylor, A deeply knotted protein structure and how it might fold. Nature. Aug. 24, 2000;406(6798):916-9.

Wagner et al., A light-sensing knot revealed by the structure of the chromophore-binding domain of phytochrome. Nature. Nov. 17, 2005;438(7066):325-31.

Williams et al,. Tiamat: A Three-Dimensional Editing Tool for Complex DNA Structures. DNA Computing 2009, 90-101.

Winters et al., Surface science aspects of etching reactions. Surface Science Reports. 1992, 14(4-6): 162-269.

Wu et al., High aspect ratio silicon etch: A review. Journal of Applied Physics, 2010, 108(5): 051101-051101-20.

Xiao et al., Selfassembly of Metallic Nanoparticle Arrays by DNA Scaffolding. Journal of Nanoparticle Research. Aug. 1, 2002;4:313-7.

Yang et al., DNA Origami with Double-Stranded DNA as a Unified Scaffold. ACS Nano, 2012, 6(9): 8209-8215.

Zhang et al., Structural DNA nanotechnology: state of the art and future perspective. J Am Chem Soc. Aug. 13, 2014;136(32):11198-211. doi:10.1021/ja505101a. Epub Jul. 28, 2014.

U.S. Appl. No. 14/440,907, filed May 6, 2015, Published, 2015-0329584[1].

U.S. Appl. No. 15/312,854, filed Nov. 21, 2016, Pending.

U.S. Appl. No. 15/124,066, filed Sep. 7, 2016, Pending.

PCT/US2015/032198, Dec. 11, 2015, International Search Report and Written Opinion.

PCT/US2015/032198, Dec. 1, 2016, International Preliminary Report on Patentability.

PCT/US2015/019135, Sep. 22, 2016, International Preliminary Report on Patentability.

PCT/US2016/020893, May 31, 2016, International Search Report and Written Opinion.

\* cited by examiner

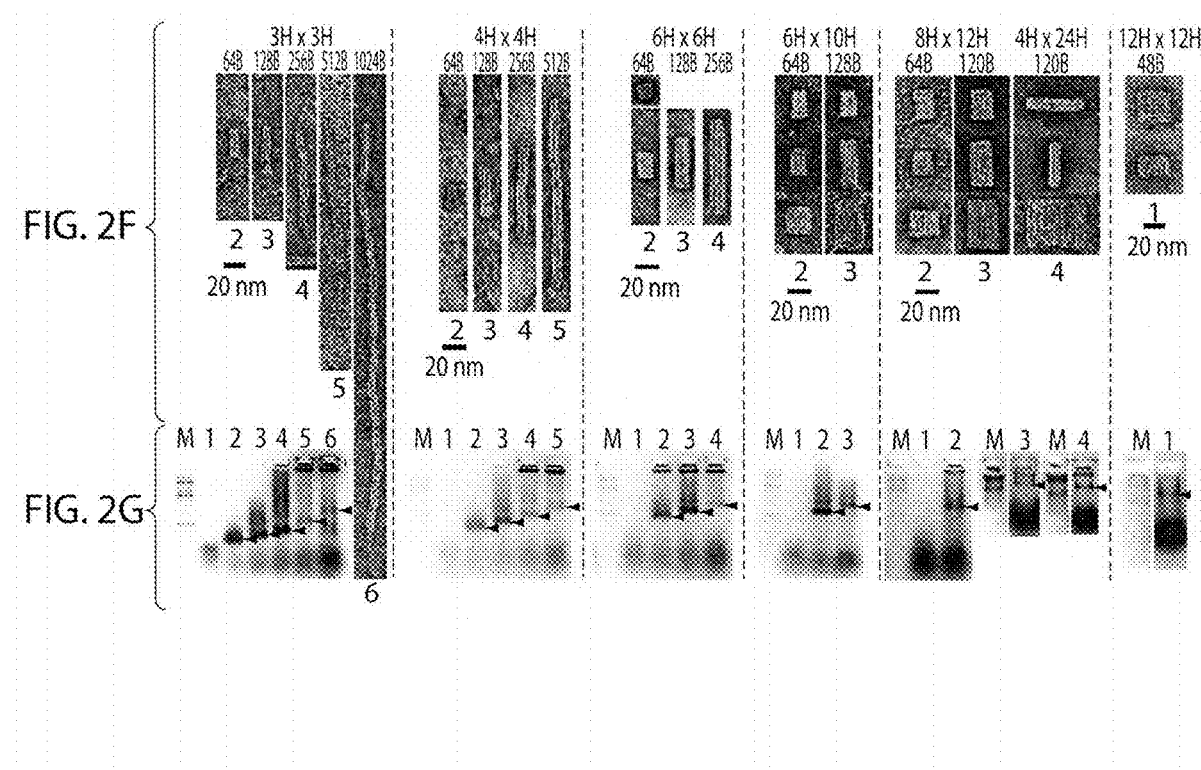

Single-stranded DNA building brick

To: FIG. 6B

From: FIG. 6A

To: FIG. 6C

From: FIG. 6B

Diamond-lattice

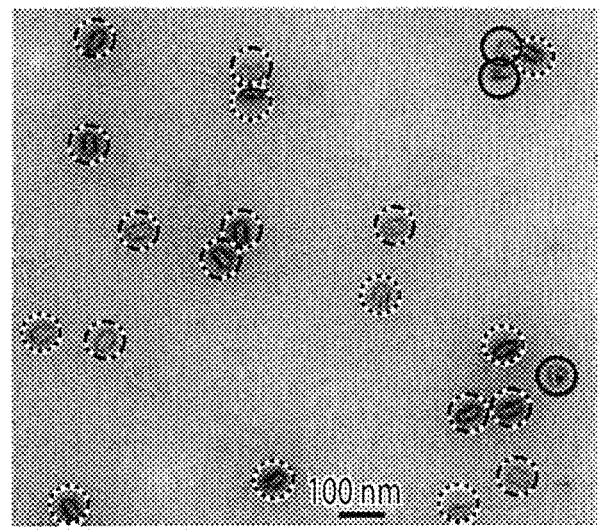
FIG. 12A
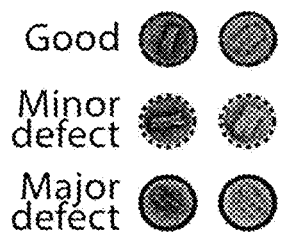
FIG. 12B
| Sample | Good | Ok | Bad | Yield (%) |
|---|---|---|---|---|
| 6Hx10Hx128B | 109 | 44 | 47 | 54.5 |
FIG. 12C Modified design = 8bp voxel = 8 bases Random Sequences

= TTTTTTTT

Four voxels

Three voxels

SELF-ASSEMBLY OF NUCLEIC ACID NANOSTRUCTURES

RELATED APPLICATIONS

This application is a national stage filing under 35 U.S.C. § 371 of international application number PCT/US2013/051891, filed Jul. 24, 2013, which claims the benefit under 35 U.S.C. § 119(e) of U.S. provisional application No. 61/675,309, filed Jul. 24, 2012, and U.S. provisional application No. 61/773,715, filed Mar. 6, 2013, each of which is incorporated by reference herein in its entirety.

GOVERNMENT SUPPORT

This invention was made with government support under OD004641 and OD007292 awarded by National Institutes of Health, under N000014-09-1-1118, N00014-10-1-0827, W911NF-12-1-0420, W911NF-12-1-0238, and N00014-11-1-0914 awarded by U.S. Department of Defense, and under 1054898 awarded by the National Science Foundation. The government has certain rights in the invention.

FIELD OF THE INVENTION

Aspects and embodiments of the invention relate to the field of nucleic acid nanotechnology.

BACKGROUND OF INVENTION

Self-assembly of informational polymers such as nucleic acids (e.g., DNA and RNA) provides an effective approach for constructing sophisticated synthetic molecular nanostructures and devices (N. C. Seeman, Nature 421, 427 (2003)). The fundamental principle for designing self-assembled nucleic acid nanostructures is that sequence complementarity in nucleic acid strands is encoded such that, by pairing up complementary segments, the nucleic acid strands self-organize into a predefined nanostructure under appropriate physical conditions. From this basic principle (N. C. Seeman, J. Theor. Biol. 99, 237 (1982)), researchers have created diverse synthetic nucleic acid nanostructures (N. C. Seeman (2003); W. M. Shih, C. Lin, Curr. Opin. Struct. Biol. 20, 276 (2010)) such as lattices (E. Winfree, et al. Nature 394, 539 (1998); H. Yan, et al. Science 301, 1882 (2003); H. Yan, et al. Proc. Natl. Acad. of Sci. USA 100, 8103 (2003); D. Liu, et al. J. Am. Chem. Soc. 126, 2324 (2004); P. W. K. Rothemund, et al. PLoS Biology 2, 2041 (2004)), ribbons (S. H. Park, et al. Nano Lett. 5, 729 (2005); P. Yin, et al. Science 321, 824 (2008)), tubes (H. Yan Science (2003); P. Yin (2008)), finite two-dimensional (2D) and three dimensional (3D) objects with defined shapes (J. Chen, N. C. Seeman, Nature 350, 631 (1991); P. W. K. Rothemund, Nature 440, 297 (2006); Y. He, et al. Nature 452, 198 (2008); Y. Ke, et al. Nano. Lett. 9, 2445 (2009); S. M. Douglas, et al. Nature 459, 414 (2009); H. Dietz, et al. Science 325, 725 (2009); E. S. Andersen, et al. Nature 459, 73 (2009); T. Liedl, et al. Nature Nanotech. 5, 520 (2010); D. Han, et al. Science 332, 342 (2011)), and macroscopic crystals (J. P. Meng, et al. Nature 461, 74 (2009)). Many dynamic devices have been constructed in parallel (J. Bath, A. J. Turberfield Nature Nanotech. 2, 275 (2007)), including tweezers (B. Yurke, et al. Nature 406, 605 (2000)), switches (H. Yan, et al. Nature 415, 62 (2002)), walkers, (W. B. Sherman, N. C. Seeman, Nano Letters 4, 1203 (2004); P. Yin, et al. Nature 451, 318 (2008); T. Omabegho, et al. Science 324, 67 (2009)) and circuits (P. Yin (2008); G. Seelig, et al. Science 314, 1585 (2006); L. Qian, E. Winfree, Science 332, 1196 (2011)). Additionally, as DNA and RNA can be interfaced with other functional molecules in a technologically relevant way, synthetic nucleic acid nanostructures promise diverse applications. Researchers are using synthetic DNA/RNA nanostructures and devices to direct functional material arrangements (E A. Aldaye, et al. Science 321, 1795 (2008)), to develop bioimaging probes (H. M. T. Choi, et al. Nature Biotechnol. 28, 1208 (2010)), to organize and regulate molecular pathways in living cells (S. Venkataraman, et al. Proc. Natl Acad. Sci. USA 107, 16777 (2010); C. J. Delebecque, et al. Science 333, 470 (2011)), and to facilitate nuclear magnetic resonance (NMR) protein nanostructure determination (M. J. Berardi, et al. Nature 476, 109 (2011)).

An effective method for assembling megadalton nanoscale 2D (P. W. K. Rothemund (2006)) and 3D shapes (S. M. Douglas (2009); E. S. Andersen (2009); D. Han (2011)) is DNA origami, in which a long "scaffold" strand is folded to a predesigned shape via interactions with short "staple" strands. The requirement of a long scaffold-strand component (often viral genomic DNA) has limited the sequence and material choices of DNA origami nanostructures. Furthermore, each shape typically requires a new scaffold routing and therefore a completely different set of staple strands.

SUMMARY OF INVENTION

The present invention generally provides methods for self-assembly of nucleic acid structures of known, predetermined and thus controlled size, shape and complexity, as well as the nucleic acid structures themselves. More specifically, in various aspects, the invention provides modular methods for producing complex nucleic acid structures using a subset of defined and predetermined oligonucleotides without the need for a longer scaffold strand that is essential in a DNA origami approach. The nucleic acid structures of the invention self-assemble in a sequence-specific manner through local interactions, typically in a one-step annealing reaction. The nucleic acid structures, and the single-stranded oligonucleotides that are used to produce such structures, are designed so that the oligonucleotide and therefore the nucleotide sequence at each location in the structure is known. The knowledge facilitates modification of the structure in a defined and controlled manner.

The invention provides, in part, methods for making three-dimensional (3D) nucleic acid structures of arbitrary, predefined shape and size using as a theoretical starting point a 3D canvas of desired height, depth and width made up of known oligonucleotides at known positions. By selecting only a subset of the oligonucleotides that make up the entire canvas, an end user can generate a nucleic acid structure of virtually any size, shape and complexity.

The oligonucleotides that form a nucleic acid structure are typically comprised of domains. Typically, domains in one oligonucleotide hybridize to domains in other oligonucleotides. Some oligonucleotides are 4-domain oligonucleotides and each domain hybridizes to a domain in separate oligonucleotides. A duplex is formed by hybridization of complementary domains, each domain located on one neighboring oligonucleotide (one domain on one oligonucleotide binds to another domain in another nearby oligonucleotide). Typically, an approximately 90° dihedral angle is formed by hybridization of complementary domains, each domain located on physically separate oligonucleotides. Nucleic acid structures of the invention are comprised of nucleic acid duplexes (i.e., a pair of hybridized or partially hybridized oligonucleotides), with adjacent duplexes connected by a single phosphate bond (i.e., crossover). Typically, a plurality of single-stranded oligonucleotides anneals to form adjacent duplexes. In some instances, during self-assembly, a 4-domain oligonucleotide adopts a helical conformation such that two (of the four) domains reside in one duplex and the remaining two domains reside in an adjacent duplex.

The invention also provides the single-stranded oligonucleotides used to generate the nucleic acid structures. Different pluralities of single-stranded oligonucleotides are provided, with the nature and composition of those pluralities depending on the design, including shape, size and complexity, of the desired structure. As explained in greater detail herein, these pluralities typically comprise 2-domain or 4-domain oligonucleotides (though, they may contain 3 domains or more than 4 domains). In some instances, the domains are of equal nucleotide length (e.g., 8 nt length). Each domain of an oligonucleotide may unique (i.e., it may have a nucleotide sequence that is present only once per oligonucleotide, or present only once per nucleic acid structure), or only one, two or three or more domains in an oligonucleotide may be unique. Each single-stranded oligonucleotide in a nucleic acid structure may be unique (i.e., it may be present only once per structure), or it may be present once, twice, three times, or even more frequently. It is to be understood that an oligonucleotide may be unique within the structure even if one or more of its domains is not.

The single-stranded oligonucleotides and the nucleic acid structures of the invention are modular in nature. The methods of the invention allow for variously shaped nucleic acid structures to be made by inclusion, exclusion and/or modification (including replacement) of a subset of known oligonucleotides. The methods described herein contemplate modular assembly of nucleic acid structures to each other, for example by annealing such structures to each other based on sequence specificity. In some of these embodiments, the nucleic acid structures that are annealed to each other may share a common shape (e.g., both may be cubes or abstract shapes). The methods also contemplate composite nucleic acid structures made by linking two or more nucleic acid structures to each other using linkers that may or may not be integral to the nucleic acid structure. In these embodiments, nucleic acid structures that are linked to each other may be of the same or of different shape.

Methods of synthesis of nucleic acid structures are also contemplated herein. Synthesis methods may comprise combining a plurality of known single-stranded oligonucleotides in a single vessel and allowing the oligonucleotides to self-assemble, in a predetermined manner, under suitable conditions. Similarly, two or more nucleic acid structures may be combined in a single vessel and allowed to self-assemble based on nucleotide sequence complementarity in a predetermined manner, under suitable conditions, thereby forming a larger nucleic acid structure.

Thus, in one aspect, the invention provides a nucleic acid structure comprising two single-stranded oligonucleotides, each comprising at least four domains arranged to form an approximately 90° dihedral angle by hybridization of two complementary domains, one in each of the oligonucleotides.

In some embodiments, the structure comprises five single-stranded oligonucleotides, each comprising at least four domains, wherein four of the single-stranded oligonucleotides are hybridized to separate domains of the fifth single stranded oligonucleotide, thereby forming an approximately 90° dihedral angle between each pair of hybridized oligonucleotides.

In some embodiments, the at least four domains are of equal nucleotide length. In some embodiments, each oligonucleotide comprises two or more unique domains. In some embodiments, at least one domain comprises a poly-thymine (T) oligonucleotide. In some embodiments, at least two domains comprise a poly-thymine(T) oligonucleotide. In some embodiments, each domain is 8 nucleotides in length. In some embodiments, the nucleic acid structure further comprises single-stranded 2-domain oligonucleotides.

In some embodiments, the oligonucleotides are DNA oligonucleotides. In some embodiments, the oligonucleotides are L-DNA oligonucleotides. In some embodiments, the oligonucleotides are crosslinked.

In some embodiments, the structure comprises 100, 500, or 1000 single stranded oligonucleotides. In some embodiments, all of the single stranded oligonucleotides are unique in sequence. In some embodiments, all of the domains are unique in sequence. In some embodiments, all of the domains except for poly-T domains are unique in sequence. In another aspect, the invention provides a plurality of any of the foregoing nucleic acid structures. In some embodiments, the nucleic acid structures are hybridized to form a 3D structure. In some embodiments, the 3D structure is defined by a "x" helices in the x direction, "y" helices in the y direction, and "z" bases (or base pairs) in the z direction. In some embodiments, the 3D structure is a cuboid structure, a cylindrical structure, a sheet, a honeycomb structure, or a hexagonal lattice structure. In some embodiments, the 3D structure is a Z-crystal, a ZX-crystal, a Y-crystal, an X-crystal or an XY-crystal.

In some embodiments, each single-stranded oligonucleotide in the plurality of structure is unique.

In another aspect, the invention provides a composition comprising the plurality of any of the foregoing nucleic acid structures.

In another aspect, the invention provides a method comprising annealing in a vessel a plurality of unique single-stranded oligonucleotides, each comprising at least four domains arranged to form an approximately 90° dihedral angle by hybridization of two complementary domains, each in a physically separate oligonucleotide. In some embodiments, the plurality of single-stranded oligonucleotides comprises 4-domain and 2-domain oligonucleotides.

In some embodiments, the single-stranded oligonucleotides are present at approximately equal molar concentrations. In some embodiments, the annealing occurs through a temperature transition over a period of time. In some embodiments, the temperature transition is a change in temperature from an elevated temperature to about room temperature. In some embodiments, the temperature transition is a change in temperature from about 90° C. to about room temperature.

In some embodiments, the annealing occurs over a period of about 12-24 hours. In some embodiments, the oligonucleotides are at least 32 nucleotides in length. In some embodiments, each domain is 8 nucleotides in length.

In some embodiments, the single-stranded oligonucleotides are DNA oligonucleotides. In some embodiments, the single-stranded DNA oligonucleotides are L-DNA oligonucleotides.

In another aspect, the invention provides a method comprising providing a three-dimensional (3D) computer-generated canvas of single-stranded oligonucleotides arranged as $N_x \times N_y \times N_z$ voxels, wherein N is a single 8 bp region comprised of two complementary hybridized domains from separate single stranded oligonucleotides that form an approximately 90° dihedral angle upon said hybridization, X is any number along the x-axis of the 3D canvas, Y is any number along the y-axis of the 3D canvas, and Z is any number along the z-axis of the 3D canvas; removing from the 3D computer-generated canvas one or more voxels to produce a 3D nucleic acid structure of a desired shape and/or size; and identifying a subset of single-stranded oligonucleotides required for assembly of the 3D nucleic acid structure.

In another aspect, the invention provides a composition comprising a first oligonucleotide comprising at least four domains hybridized to a second oligonucleotide, wherein the second oligonucleotide is hybridized at one of the four domains of the first oligonucleotide, thereby forming a 90° dihedral angle between the first and second oligonucleotides.

In some embodiments, a third oligonucleotide is hybridized to the first oligonucleotide at one of the remaining domains of the first oligonucleotide, thereby forming a 90° dihedral angle between the first and third oligonucleotides. In some embodiments, a fourth oligonucleotide is hybridized to the first oligonucleotide at the remaining domain of the first oligonucleotide, thereby forming a 90° dihedral angle between the first and fourth oligonucleotides. In some embodiments, hybridization of two complementary domains, each from physically separate oligonucleotides, results in a double helix. In some embodiments, the second, third and fourth oligonucleotides consist of 2 domains, 3 domains, 4 domains, or more than 4 domains. In some embodiments, the second, third and fourth oligonucleotides are each hybridized to one, two, three or more oligonucleotides, thereby forming 90° dihedral angles between hybridized oligonucleotides.

It should be appreciated that all combinations of the foregoing concepts and additional concepts discussed in greater detail below (provided such concepts are not mutually inconsistent) are contemplated as being part of the inventive subject matter disclosed herein. In particular, all combinations of claimed subject matter appearing at the end of this disclosure are contemplated as being part of the inventive subject matter disclosed herein. It should also be appreciated that terminology explicitly employed herein that also may appear in any disclosure incorporated by reference should be accorded a meaning most consistent with the particular concepts disclosed herein.

BRIEF DESCRIPTION OF THE FIGURES

It is to be understood that the Figures are not necessarily to scale, emphasis instead being placed upon generally illustrating the various concepts discussed herein.

FIG. 2F shows TEM images of 3D DNA-block nanostructures in FIG. 2E. FIG. 2G shows images of agarose gel electrophoresis for 3D DNA-block nanostructures. For each group of nanostructures, lane M shows a 1 kb ladder; other lanes are labeled with numbers matching their designs in FIG. 2E. Product bands (indicated by gray arrows) were extracted for purification and TEM imaging.

FIG. 5A shows that DNA bricks can be designated as north-bricks, west-bricks, south-bricks, or east-bricks, based on their orientations. Arrows indicate the 3' ends. FIG. 5B shows two bricks that interact via hybridization of two complementary 8 nucleotide domains.

FIG. 6A shows a cylinder model of a 4H×4H×64B cuboid 3D nanostructure (or 4 voxels×4 voxels×8 voxels). Each voxel represents an 8 base pair duplex that is formed by base-pairing of a pair of a X-brick and a Y-brick. FIGS. 6B and 6C show a 3D strand diagram. Each strand has its unique sequence. FIGS. 6D and 6E show helix and strand diagrams in caDNAno format, which is used by our custom programs. FIG. 6D shows an X-Y cross-section looking down the Z- direction. FIG. 6E shows a detailed strand diagram of all strands. The numbers in columns represent the helices. The numbers at the top and bottom indicate the position of the base-pairs along Z-axis. X-bricks are represented by the dark gray lines, and Y-bricks are represented by the light gray lines. Arrows indicate the 3' end of strands. FIG. 6F shows a 3D strand diagram showing all X-bricks and Y-bricks.

FIG. 7A shows a 32 nucleotide DNA brick. FIG. 7B shows another drawing representing the same 32 nt strand. Each 8 nucleotide segment is labeled A, B, C or D. FIG. 7C shows interactions between an X-brick and its four neighboring Y-bricks. Complementarity is indicated by similar colors and associating symbols. For instance, segment A is complementary to segment A*; the two segments are also shown by the matching color. FIG. 7D shows the X-bricks, and its four neighboring Y-bricks are shown in close proximity. FIG. 7E shows a ball-and-stick model showing the connection between an X-brick and its four neighboring Y-bricks. They form a tetrahedron structure, with the X-brick at the center and each of four Y-brick occupying a vertex. FIG. 7F shows the connection pattern of a large group of DNA strands resembles a diamond-lattice.

FIG. 8A shows the 6H×6H×64B structure that was used for this experiment. All samples were self-assembled using 72-hour annealing protocol. FIG. 8B shows an agarose gel assaying self-assembly of a 6H×6H×64B structure with a random sequence design. Lane M shows 1 kb ladder. Lane 1 to lane 6 show 6H×6H×64B self-assembled at 200 nM concentration with 10, 20, 30, 40, 50, 60 mM $MgCl_2$. 20 μL sample is loaded into each lane from 1 to 6. FIG. 8C shows an agarose gel assaying self-assembly of 6H×6H×64B with designed sequence. Lane M shows 1 kb ladder. Lane 1 to lane 6 show 6H×6H×64B self-assembled at 200 nM concentration with 10, 20, 30, 40, 50, 60 mM $MgCl^2$. A 20 μL sample is loaded into each lane from 1 to 6.

FIG. 9A shows a 5H×5H×48B cylinder model of 3D structures. FIG. 9B shows the Y1-layer contains five helices—X1, X2, X3, X4, X5. Only X-bricks in the Y1-layer are shown. Some strands (i, ii, iii, iv) on the boundary form short 16 nucleotide boundary strands. FIG. 9C shows most of these short 16 nucleotide boundary strand can be connected with the 32 nucleotide strand on their left to form 48 nucleotide boundary strands.

FIG. 10A shows a 6H×6H×64B structure that was used to test the 16 nucleotide short boundary strands and 48 nucleotide long boundary strands. The design using 16 nucleotide boundary strands is designated 6H×6H×64B-S. The oligonucleotide sequences used to produce a 6H×6H×64B-S nucleic acid structure of the invention are designated SEQ ID NOs. 1-78, 157-225 and 295-336. (See also Appendix, Table 1 of U.S. provisional application No. 61/675,309, filed Jul. 24, 2012, incorporated by reference herein.) The design using 48 nucleotide boundary strands is designated 6H×6H×64B. The oligonucleotide sequences used to produce a 6H×6H×64B nucleic acid structure of the invention are designated SEQ ID NOs. 79-156 and 226-294. (See also Appendix, Table 1 of U.S. provisional application No. 61/675,309, filed Jul. 24, 2012, incorporated by reference herein.) All samples were self-assembled using a 3-day annealing protocol. FIG. 10B shows an agarose gel assaying the self-assembly of a 6H×6H×64B-S structure. Lane M shows 1 kb ladder. Lane 1 to lane 8 show a 6H×6H×64B-S structure self-assembled at 100 nM concentration with 10, 20, 30, 40, 50, 60, 70, 80 mM $MgCl_2$. Lanes 9 to 16 show a 6H×6H×64B-S structure self-assembled at 200 nM concentration with 10, 20, 30, 40, 50, 60, 70, 80 mM $MgCl_2$. A 20 μL sample was loaded into each lane from 1 to 16. FIG. 10C shows an agarose gel assaying self-assembly of a 6H×6H×64B structure. Lane M shows a 1 kb ladder. Lane 1 to lane 8 show a 6H×6H×64B structure self-assembled at 100 nM concentration with 10, 20, 30, 40, 50, 60, 70, 80 mM MgCl$_2$. Lanes 9 to 16 show a 6H×6H×64B structure self-assembled at 200 nM concentration with 10, 20, 30, 40, 50, 60, 70, 80 mM MgCl$_2$. A 20 μL sample was loaded into each lane from 1 to 16.

FIGS. 12A-12C show yield analysis of agarose gel electrophoresis purified 6H×10H×128B structures based on TEM images. FIG. 12A is a representative TEM image of purified 6H×10H×128B. Particles circled in medium gray are categorized as "good" particles with no visible defect. Particles/structures circled in light gray/white are categorized as "minor defect" particles with minor defects. Particles circles in dark gray are categorized as "major defect" particles that have major defects or are even broken. FIG. 12B shows examples of "good", "minor defect," and "major defect" particles of purified 6H×10H×128B. FIG. 12C Data showing yield with numbers under "good," "minor defect," and "major defect," indicating the number of particles counted.

FIG. 13A shows a cylinder model of a 5H×5H×48B 3D structure. Each voxel is 8 base pairs. FIG. 13B shows the X1-layer of a 5H×5H×48B structure that is designed using the original strategy. Only the Y-bricks in the X1-layer are shown. Notice that the 48 nucleotide boundary strands (FIG. 10) are implemented. Arrows and asterisks (*) point to the positions where the crossover are removed for generating modified version. FIG. 13C shows the X1-layer of a 5H×5H×48B structure using the modified design. Compared to the original design, four crossovers were removed, and the new strands (i, ii, iii, iv, v) were incorporated by merging together the pair of strands located in the same duplex.

FIG. 14A shows an agarose gel assay of 6H×10H×128B-M structures. Lane 1 shows 6H×10H×128B structures as a control sample. Lane 2 shows 6H×10H×128B-M structures. Both samples are annealed at the same condition (200 nm per strand, 0.5×Tris buffer with 40 mM MgCl$_2$, 72-hour annealing ramp). The 6H×10H×128B-M design generates 2.9 times higher yield than 6H×10H×128B. FIG. 14B shows a representative TEM image and TEM yield of purified 6H×10H×128B-M structures. The oligonucleotide sequences used to produce 6H×10H×128B-M nucleic acid structures of the invention are designated SEQ ID NOs. 337-590. (See also Appendix, Table 6 of U.S. provisional application No. 61/675,309, filed Jul. 24, 2012, incorporated by reference herein.)

FIG. 16A depicts symbols used in this Figure. FIG. 16B shows a typical strand with four 8 nucleotide random-sequence domains. Each 8 nucleotide domain is located within a 8 base pair voxel—V1, V2, V3, or V4. V1 and V2 are on the same helix. V3 and V4 are on another adjacent helix. FIGS. 16C to 16F show other types of strand derived from the strand with four 8 nucleotide random-sequence domains. FIG. 16C shows that when one of the four 8 base pair voxel is removed, the 8 nucleotide domain corresponding to that 8 base pair voxel is changed to eight consecutive Ts. FIG. 16D shows that when two of the four 8 base pair voxels are removed, the two 8 nucleotide domains corresponding to those 8 base pair voxels are either changed to eight consecutive Ts, or deleted. The latter case happens if the two removed 8 base pair voxels are from the same helix. FIG. 16E shows that when three of the four 8 base pair voxels are removed, the two 8 nucleotide domains corresponding to the two removed voxels from the same helix are deleted. Another 8 nucleotide domain corresponding to the third removed voxel is changed to eight consecutive Ts. FIG. 16F shows that for each strand shown in B, two types of 48 nucleotide boundary strands are created. FIG. 16G shows that each strand is labeled by the positions of the voxels it covers. Each pair of numbers represents one voxel. The first number indicates the helix and the second number indicate the voxel position on the helix. Numbers (0, 0) means a domain with eight consecutive thymidines (Ts) or an empty domain.

FIG. 18A shows s 10×10×10 voxel 3D canvas. Each sphere represents one voxel. FIG. 18B shows how shape editing is performed by removal of unwanted voxels. FIGS. 18C and 18B show caDNAno files corresponding to the 10×10×10 voxel 3D canvas in FIG. 18A and the shape in FIG. 18B, respectively. The conversion from the 3D depiction to the caDNAno format was done by a custom program.

FIG. 19A shows a cylinder model of 4H×4H×64B-A (alternating design) structures. Each voxel represents 8 base pairs. FIG. 19B shows the details of strands in 4H×4H×64B-A structures. Strands point in alternating directions in along the layers. For instance, Y-bricks in X1-layer and Y-bricks in X2-layer are pointing to opposite directions, −Z and +Z direction, respectively. Accordingly, the directions of each strand is depicted as "Left" (L) or "Right" (R). FIG. 19C shows a 6H×10H×64B-A structure that was used to test the alternating design strategy. FIG. 19D shows results of an agarose gel electrophoresis assay. Lane M shows a 1 kb ladder. Lane 1 shows 6H×10H×64B-A structures. The structures were self-assembled in 0.5×Tris buffer with 40 mM MgCl$_2$, using 72-hour annealing ramp. The concentration of each strand is 200 nM. A distinctive bright band correspond to the product was extracted from the gel. FIG. 19E shows TEM images of the 6H×10H×64B-A structures after agarose gel purification. Scale bar is 100 nM for the zoom-out image and 20 nm for the zoom-in images.

FIG. 20D shows a 1D crystal growing along the Z-axis. FIG. 20E shows a 2D crystal growing along the Z-axis and the X-axis. FIG. 20F shows a 2D crystal growing along the X-axis and the Y-axis. FIG. 20H shows a 1D Z-crystal with a tunnel and periodic cavities. FIG. 20I shows a 2D ZX-crystal with two groups of parallel tunnels. FIG. 20J shows a 2D XY-crystal with periodic cavities. FIG. 20K shows a 3D ZXY-crystal with periodic cavities. Unit cells of crystals are denoted using blue-colored boxes. Arrows indicate the directions of crystal growth.

(FIG. 24A) Top, a 6H×6H×24B cuboid discrete DNA-brick structure. Bottom, the intersection of the 6H×6H×24B cuboid. (FIG. 24B) the detailed strand diagram of the 6H×6H×24B cuboid. The numbers on the left and the right indicate the helices. The numbers on the top and the bottom indicate the position of the base-pairs along the Z-axis. X-bricks are represented with dark gray lines, and Y-bricks are represented with light gray lines. (FIGS. 24C-24D) Connection patterns of one-dimensional-growth: Z-growth (FIG. 24C), X-growth (FIG. 24C), and Y-growth (FIG. 24D). (FIG. 24E) Connection patterns of two-dimensional-growth: ZX-growth and XY-growth. FIG. 24F shows a TEM image of the Z-6H×6H×32B-cuboid crystal.

FIGS. 26A-25H show TEM images of ZX-crystals. (A) ZX-4H×4H×32B-cuboid crystal; (B) ZX-4H×6H×32B-cuboid crystal; (C) ZX-4H×10H×32B-cuboid crystal; (D) ZX-4H×20H×32B-cuboid crystal; (E) ZX-32H×64B-channel crystal; (F) ZX-32H×64B-cross-channel crystal; (G) ZX-6H×6H×64B-pore crystal; and (H) ZX-96H×64B-cross-tunnel crystal.

FIGS. 27A-25I show TEM images of XY-crystals. (A) XY-48H×64B-pore crystal; (B) XY-64H×64B-pore crystal; (C) XY-4H×4H×64B-cuboid crystal; (D) XY-4H×4H×128B-cuboid crystal; (E) XY-4H×4H×192B-cuboid crystal; (F) XY-4H×4H×256B-cuboid crystal; (G) XY-32H×64B-pore crystal; (H) XY-32H×128B-pore crystal; and (I) XY-8H×4H×96B-channel crystal.

Figure 1A:
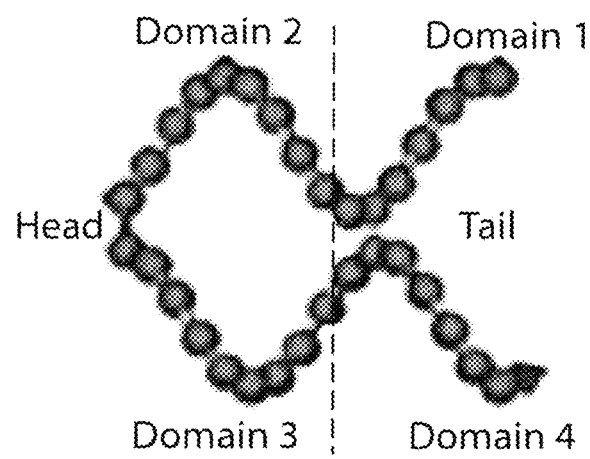
FIG. 1A is a schematic of a 32 nucleotide 4-domain single-stranded DNA oligonucleotide (also referred to herein interchangeably as a DNA "block" or a DNA "brick"). Each domain is 8 nucleotides in length. The connected domain 2 and domain 3 are "head domains"; domain 1 and domain 4 are "tail domains".

The specification further incorporates by reference in its entirety the Sequence Listing submitted herewith as a separate ASCII text file, named "H0498.70443WO00—Sequence Listing," created on Jul. 23, 2013, and having a size of 2.34 MB.

DETAILED DESCRIPTION OF INVENTION

The invention relates, in its broadest sense, to methods of making nucleic acid structures of predetermined, and thus controlled, shape, size and complexity, to the structures so made, and to the oligonucleotide pluralities used in the process. The invention is premised, in part, on the unexpected finding that select pluralities of single-stranded oligonucleotides can be self-assembled to form 3D nucleic acid structures of controlled shape, size, complexity and modification. It was considered surprising, inter alia, that stable 3D nucleic acid structures of various predetermined shapes and controlled sizes could be formed using only a plurality of relatively short single-stranded oligonucleotides (e.g., compared to the scaffold strands required for DNA origami techniques).

More particularly, various aspects of the invention relate to a method, using single-stranded 2- or 4-domain oligonucleotides (also referred to herein as "nucleic acid bricks" or "DNA bricks"), that extends modular self-assembly of nucleic acid nanostructures to three dimensions. The generality of this method was demonstrated by successfully designing and characterizing 123 nanostructures, including two 8 MDa cuboids, 102 intricate three-dimensional (3D) shapes constructed from a common cuboid "3D canvas," and 19 three-dimensional nanostructures assembled from modular nucleic acid motifs that obey alternate packing geometries. Also provided herein in various aspects is a computer program that translates a simple three-dimensional model into the set of nucleic acid strands required to generate the desired corresponding nucleic acid structure.

The nucleic acid structures of the invention comprise a plurality of oligonucleotides arranged (via sequence-specific annealing) into three-dimensional shapes in a predetermined or known manner. As a result, the position of each oligonucleotide in the structure is known. In this way, the structure may be modified, for example, by adding, removing or replacing oligonucleotides at particular positions. The structure may also be modified, for example, by attachment of moieties, at particular positions. This may be accomplished by using a modified oligonucleotide as a starting material or by modifying a particular oligonucleotide after the structure is formed. Therefore, knowing the position of each of the starting oligonucleotides in the resultant structure provides addressability to the structure.

The nucleic acid structures of the invention may be made, in some instances, through a process of self-assembly of single-stranded oligonucleotides. In these self-assembly methods, the single-stranded oligonucleotides are combined in a single vessel and allowed to anneal to each other, based on sequence complementarity. In some instances, this annealing process involves placing the oligonucleotides at an elevated temperature and then reducing the temperature gradually in order to favor sequence-specific binding. As used herein, the term "self-assembly" refers to the ability of oligonucleotides (and in some instances nucleic acid structures) to anneal to each other, in a sequence-specific manner, in a predicted manner and without external control (e.g., by sequential addition of oligonucleotides or nucleic acid structures).

The invention therefore provides, inter alia, compositions comprising the single-stranded oligonucleotides of the invention, methods of making nucleic acid structures of various predetermined or known size, shape, complexity and modification, nucleic acid structures of various predetermined or known size, shape, complexity and modification, pluralities of nucleic acids wherein such pluralities may self-assemble to form three-dimensional nucleic acid structures, composite structures comprising two or more nucleic acid structures, and methods of making such composite structures. The invention also provides methods of using the nucleic acid structures and the composite structures of the invention. These aspects and embodiments of the invention will be described in greater detail herein.

Nucleic Acid Structures

Figure 5A:
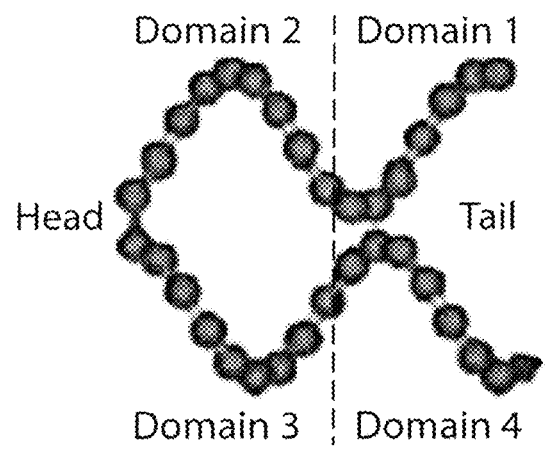
FIGS. 5A and 5B show a LEGO®-like model that differentiates each domain within a DNA brick.

The nucleic acid structures of the invention are comprised of a plurality of oligonucleotides that are bound to each other in a sequence-specific manner to form 3D shapes. The oligonucleotides of the invention may have four domains, though in some embodiments, an oligonucleotide can have 2, 3, 4, 5, 6, 7, 8, 9, 10, 11, 12, 13, 14, 15, 16, 17, 18, 19, 20, or more domains. The number of domains depends, at least is part, on the length of the oligonucleotide. Thus, longer oligonucleotides greater than 200 nucleotides, for example, can have more than 20 domains. FIGS. 1A and 5A provide a schematic of a 4-domain oligonucleotide, each domain having eight nucleotides. Prior to the annealing process that forms the nucleic acid structure, the oligonucleotides are in a single-stranded form. The nucleotide sequence of the domains and/or oligonucleotides may be random (provided that the requisite hybridization between domains occurs). As described in greater detail herein, some domains have a poly-T sequence. Thus, some structures are comprised of random sequence domains and poly-T domains.

An oligonucleotide can be conceptualized as a "brick" (similar to a LEGO® brick, see below) having, for example, four contiguous 8-nucleotide domains, totaling 32 nucleotides in length. The domains can be designated 1, 2, 3, 4, respectively (FIG. 1A). (For clarity, in some instances the Figures may refer to X1, X2, X3 and X4 domains to indicate the four domains of an "X" brick, and Y1, Y2, Y3 and Y4 domains to indicate the four domains of a "Y" brick.) Each DNA brick bears a distinct nucleotide sequence, in some instances. All DNA bricks adopt an identical global shape when incorporated into the target structure: two 16 base pair (16-mer) antiparallel helices joined by a single phosphate linkage. The two domains adjacent to the linkage are designated as "head" domains and the other two are designated as "tail" domains. A DNA brick with a tail domain bearing sequence "a" can interact productively with a neighboring brick with a complementary "a*" head domain in a stereo-specific fashion. Each pairing between bricks defines three parallel helices packed to produce a 90° dihedral angle (FIG. 1B, top); this angle derives from the ¾ right-handed helical twist of 8 base pairs of DNA.

Figure 1B:
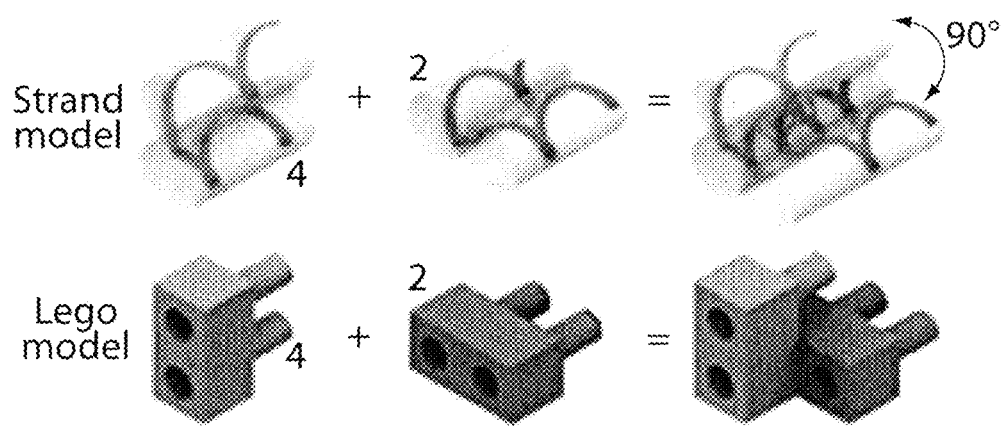
FIG. 1B is a schematic of two models that depict a DNA block and its binding interaction.
Figure 5B:
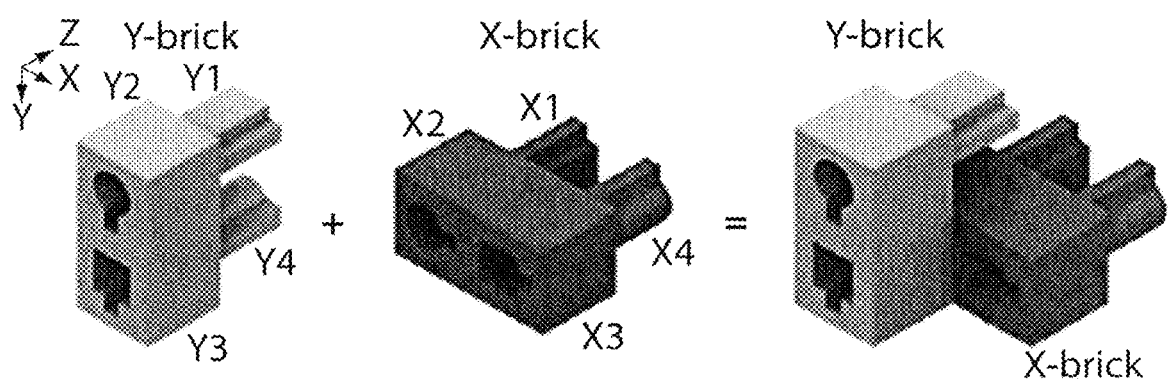
Figure 5C:
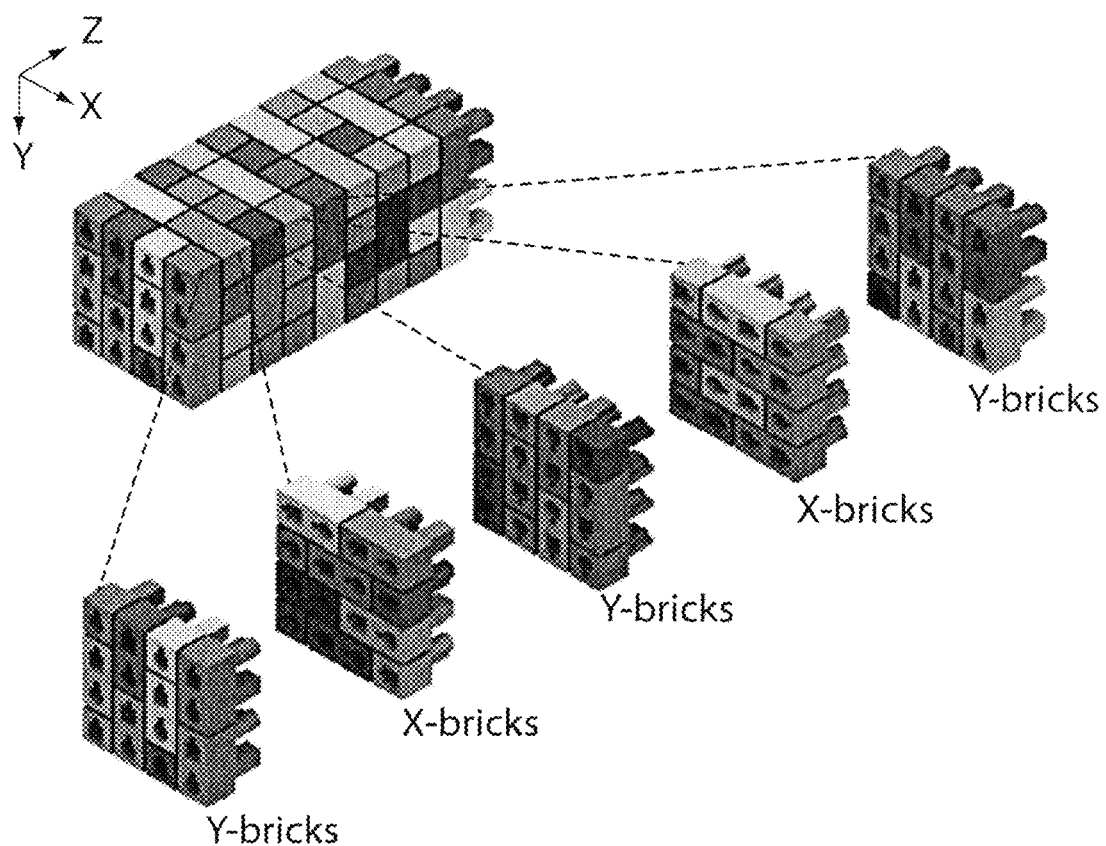
FIG. 5C is a LEGO®-like model of a 4H×4H×64B cuboid in FIG. 6. Each brick has a unique sequence, as indicated by distinct colors. In the Z+ direction, DNA bricks have same orientation within each layer; DNA bricks rotate 90° counter-clockwise with each successive layer along the Z+ direction.
Figure 6A:
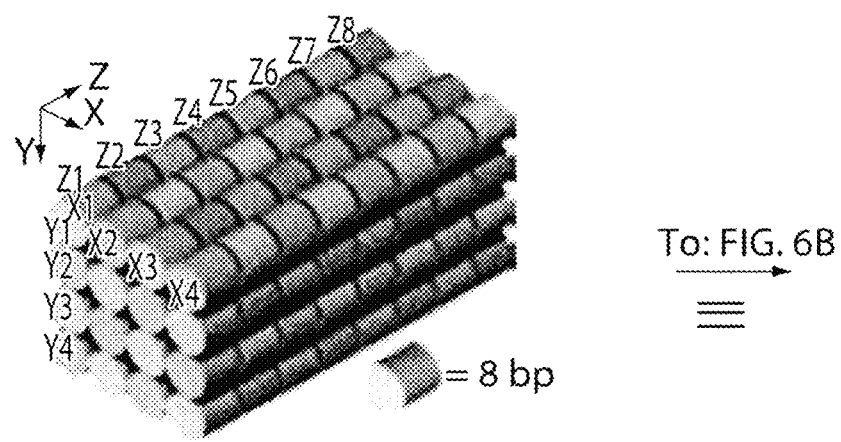
FIGS. 6A-6F show a strand diagram of DNA three-dimensional nanostructures.
Figure 6B:
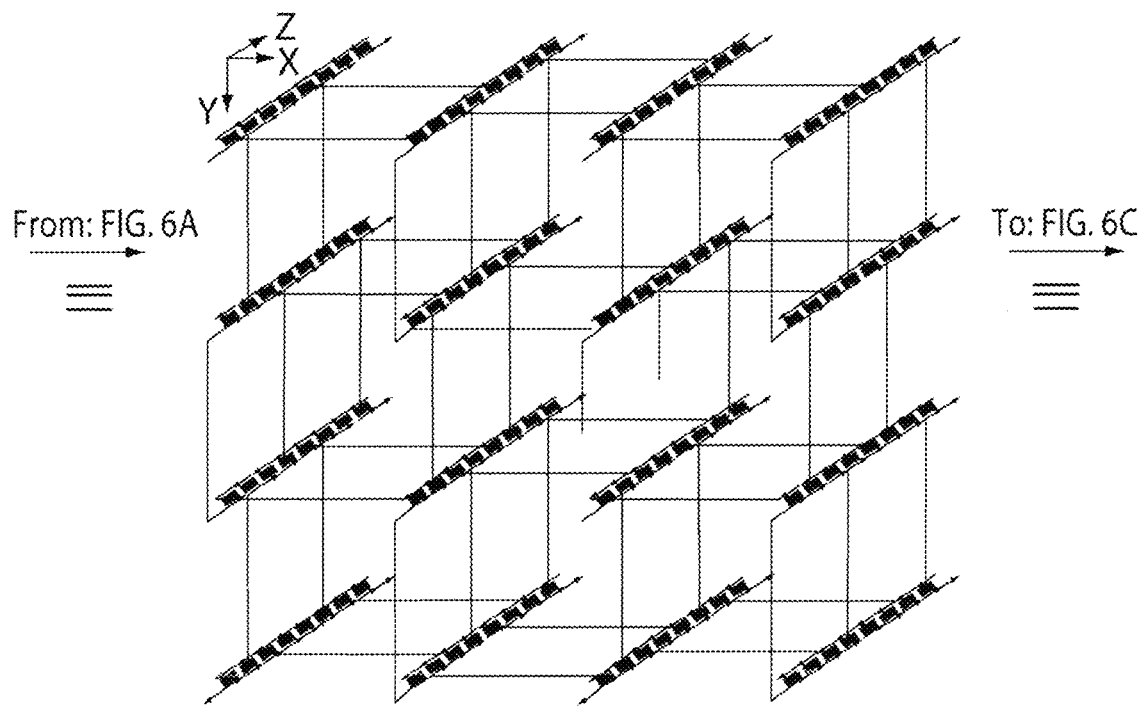
Figure 6C:
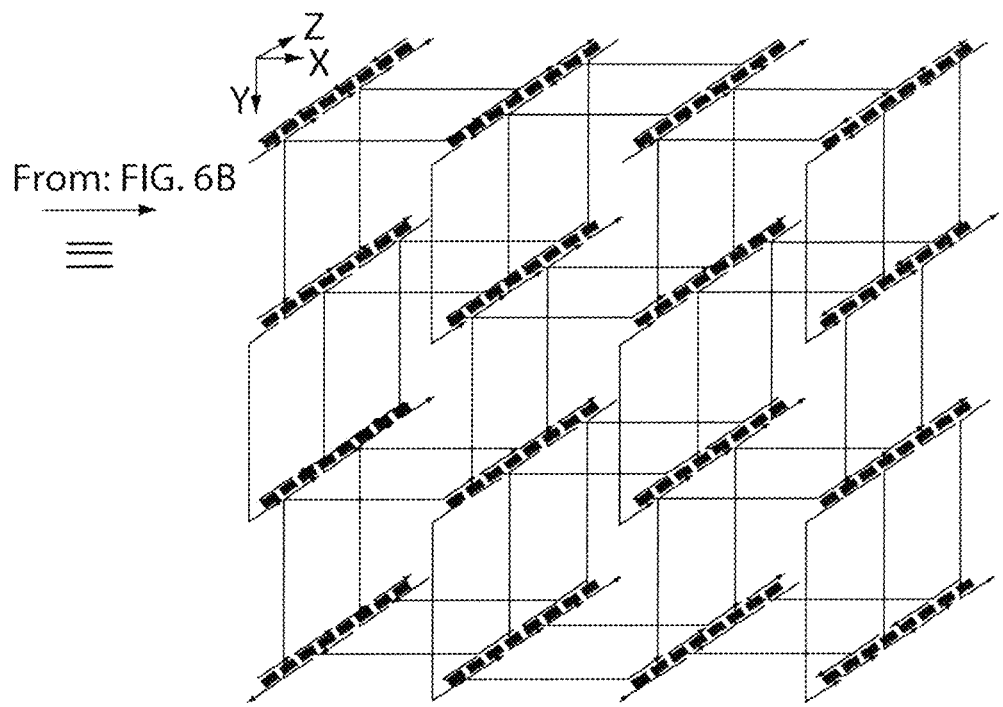
Figure 6D:
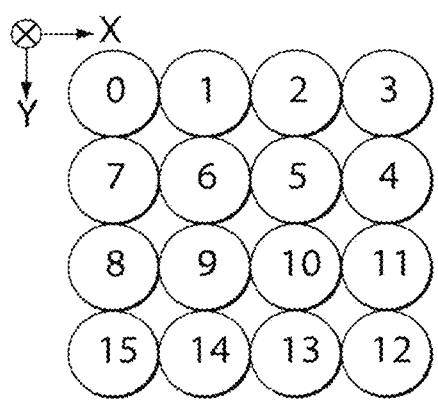
Figure 6E:
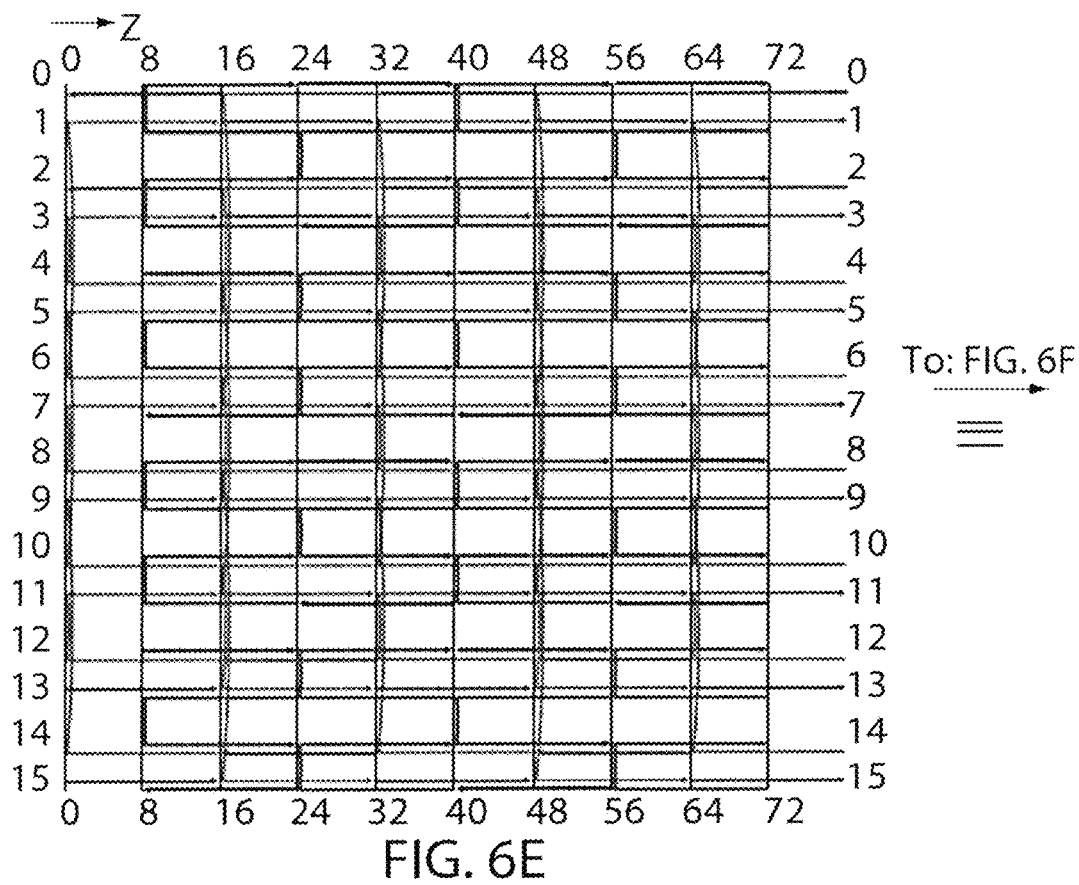
Figure 6F:
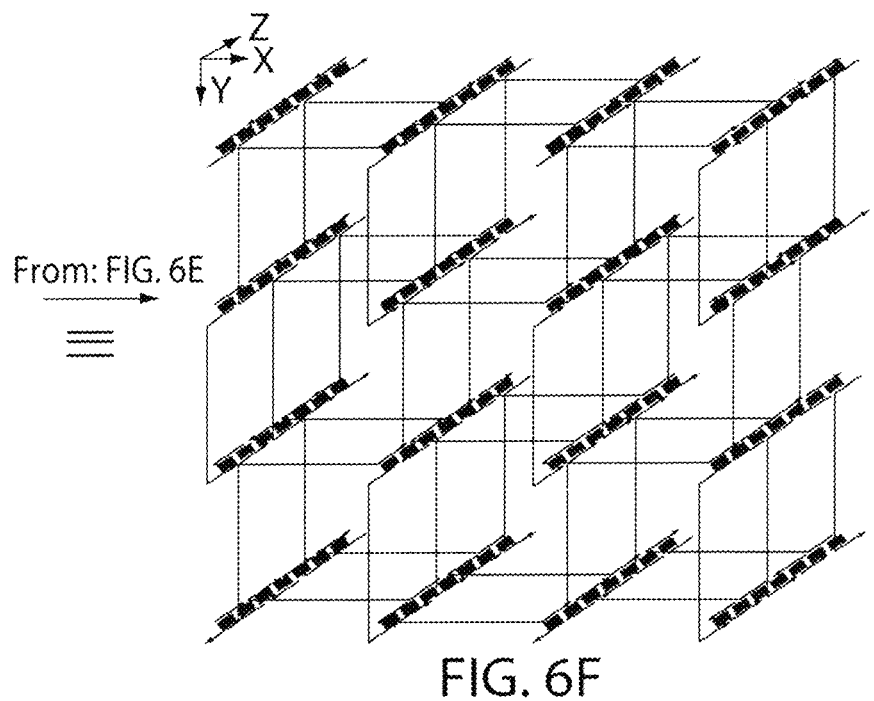
Figure 7A:
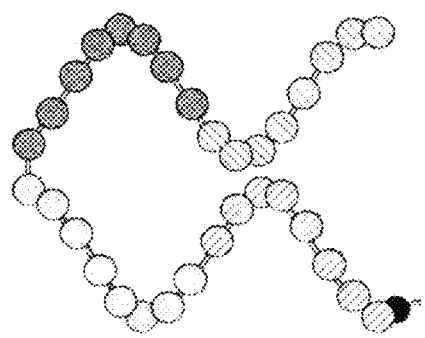
FIGS. 7A-7F show the connection between X-bricks and Y-bricks.
Figure 7B:
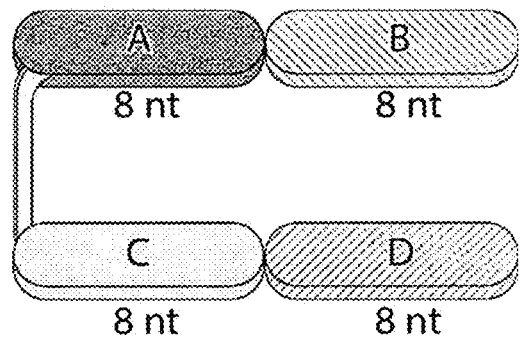
Figure 7C:
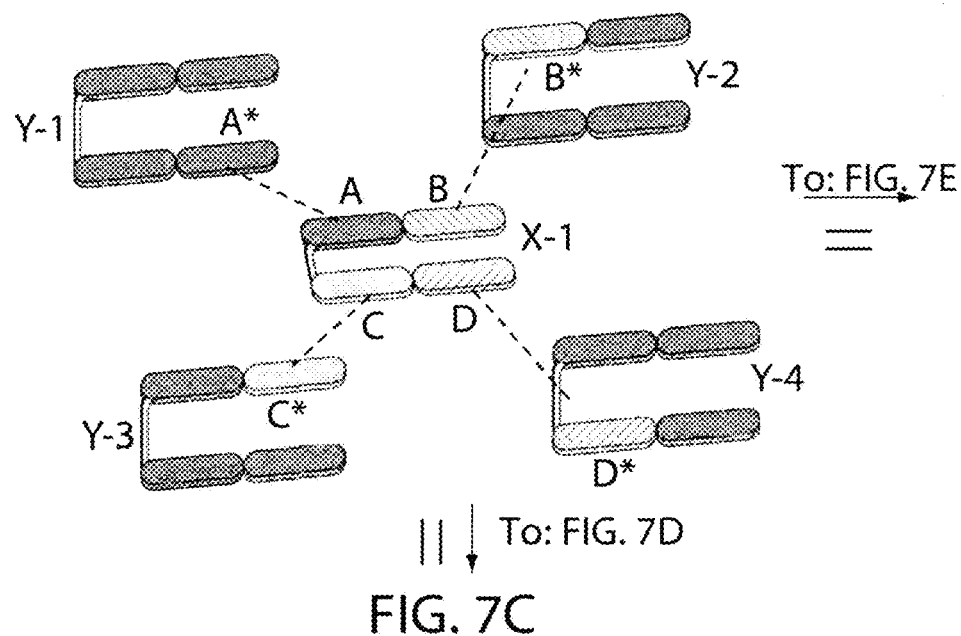
Figure 7D:
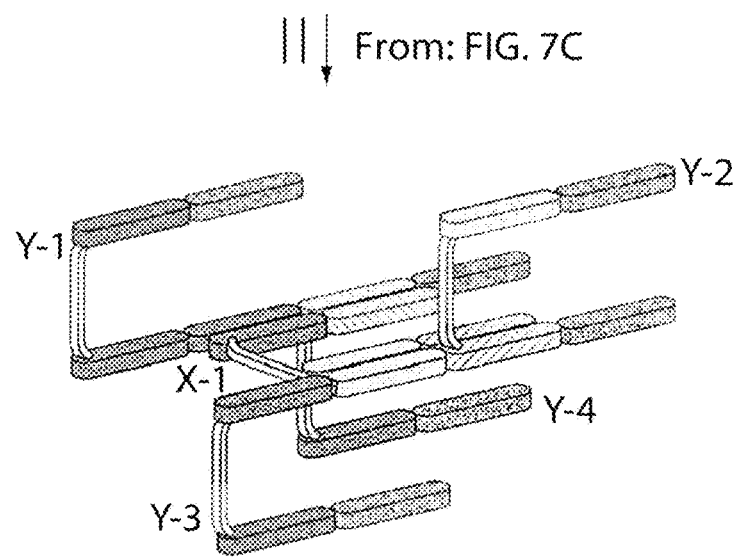
Figure 7E:
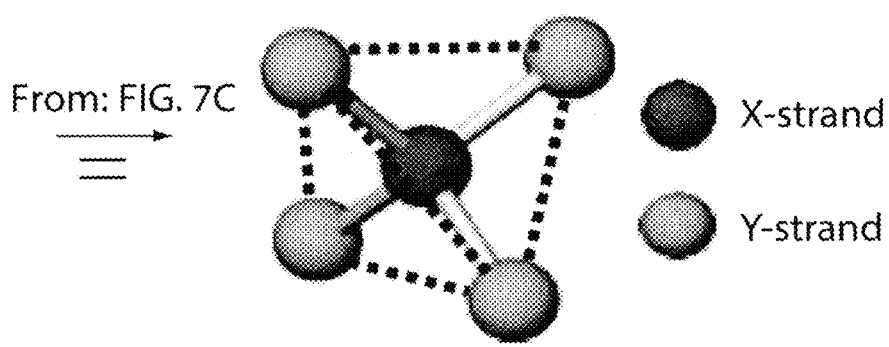
Figure 7F:
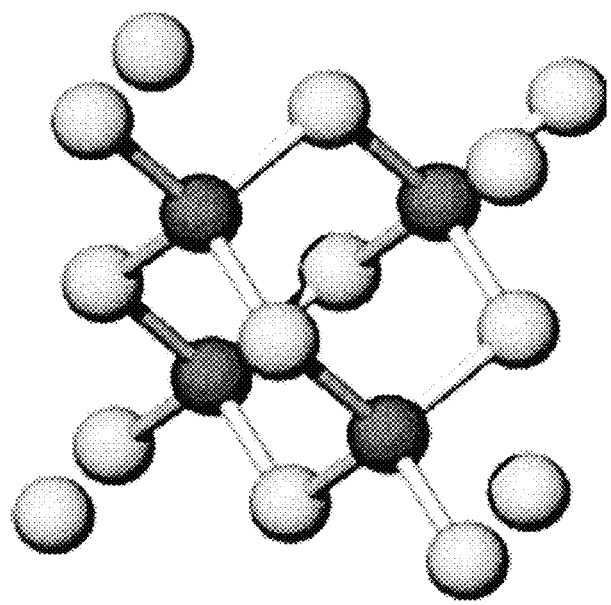

A LEGO®-like model can be used herein to depict the design in a simple manner (FIG. 1B, bottom and FIG. 5). The model overlooks the detailed helical structure and strand polarity but preserves information on aspect ratios and some of the orientational constraints on interactions between DNA bricks: the two protruding round plugs, pointing in the same direction as the helical axes, represent the two tail domains; the two connected cubes with recessed round holes represent the two head domains. A brick must adopt one of two types of orientations, horizontal or vertical (FIG. 1B). The two bricks connect to form a 90° angle via hybridization, represented as the insertion of a plug into a hole. An insertion is only allowed between a plug and a hole that carry complementary sequences with matching polarity (which is not graphically depicted in the current model for expositional simplicity). A more detailed LEGO®-like model that specifies strand polarities and stereospecific constraints on the interaction between bricks is shown in FIG. 5.

FIG. 5 shows nucleic acid bricks along successive 8 base pair layers that have orientations designated herein as north, west, south, and east. Bricks with north and south orientations may be restricted to a subset containing one helix from each double helix. Similarly, bricks with west and east orientations may be restricted to the complementary subset of helices (also see FIG. 6). Thus, it can be convenient to group the bricks oriented north and south together as Y-bricks, and to group the bricks oriented west and east together as X-bricks. In terms of domain-domain hybridization, there may be connections between a tail domain on one oligonucleotide with a head domain of another oligonucleotide in FIG. 5. Here a LEGO® model is shown that uses different protruding shapes (for tail domains 1 and 4) and matching cavities (for head domains 2 and 3). A tail domain Y4 and head domain X2 connection is demonstrated (FIG. 5B). In addition, the shapes and cavities are designed to force a pair of bricks to form a 90° dihedral angle.

Figure 1C:
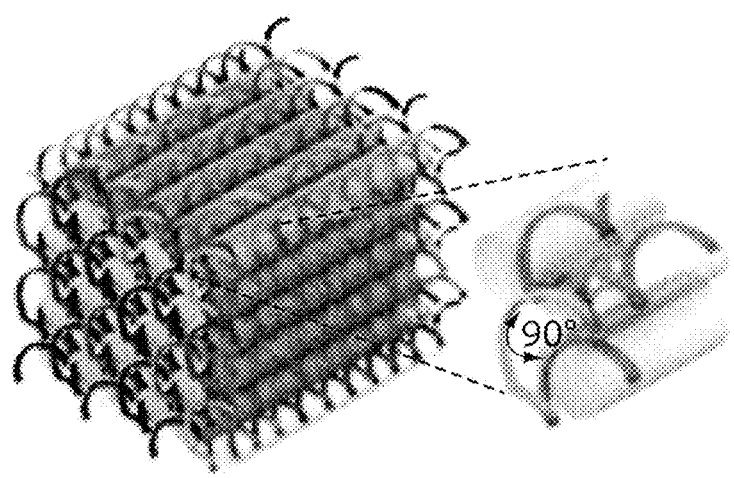
FIG. 1C is a schematic of a molecular model that shows the helical structure of a 6H (helix)×6H×48B (bp) cuboid three-dimensional DNA nanostructure. Each strand has a unique sequence. The inset shows a pair of X-strand and Y-strand.
Figure 1D:
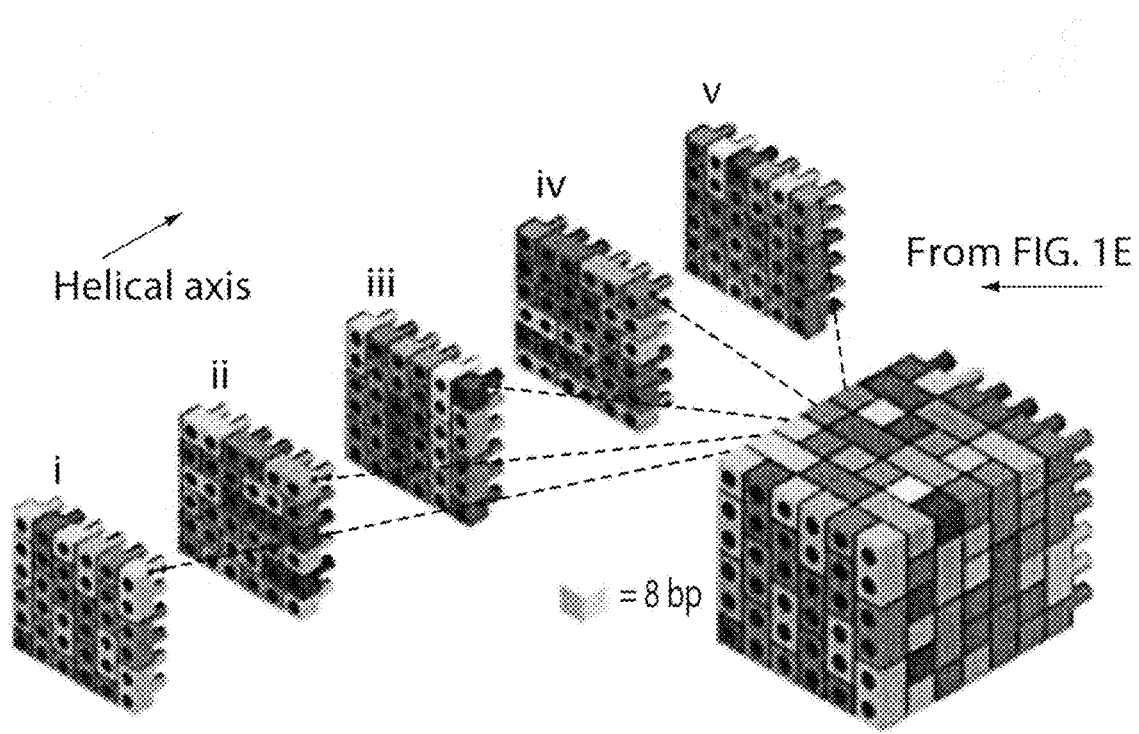
FIG. 1D is a schematic of a LEGO® model of the 6H×6H×48B cuboid. Each block has a unique sequence. There are half-blocks (i.e., 2-domain oligonucleotides) on the boundary of each layer.
Figure 1E:
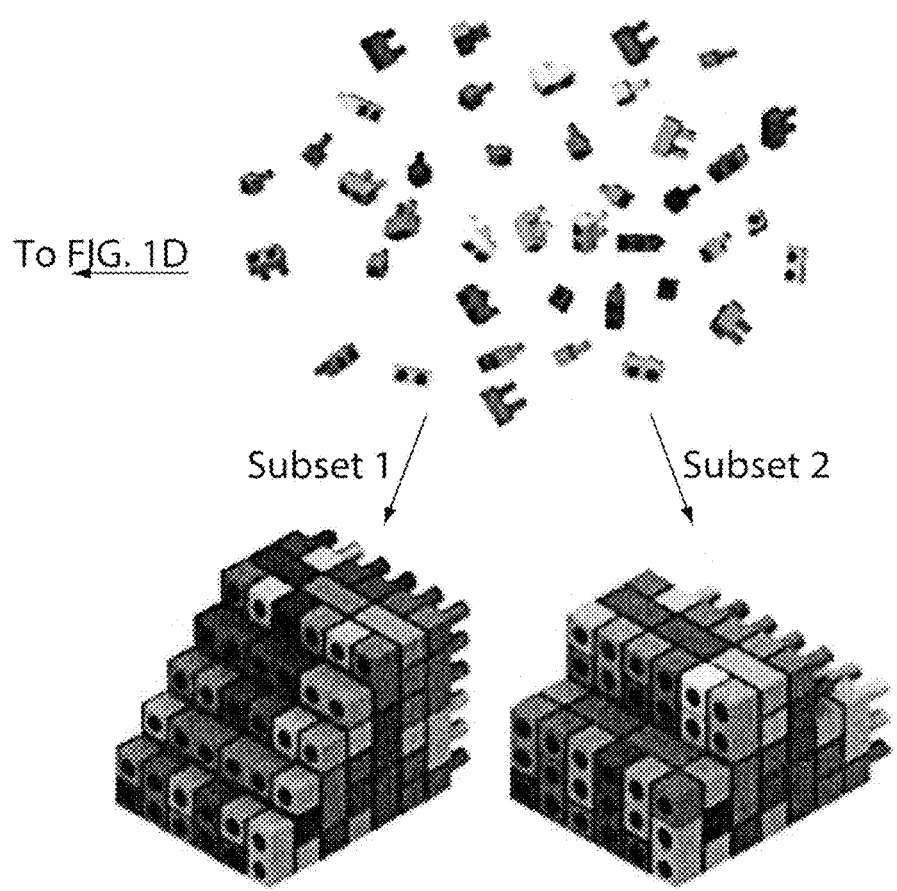
FIG. 1E is a schematic of a 6H×6H×48B cuboid self-assembled by DNA blocks. The blocks are not interchangeable during self-assembly because of the sequence uniqueness of each block. Using the 6H×6H×48B as a 3D "molecular canvas," a smaller shape can be constructed using a subset of the blocks.
Figure 1F:
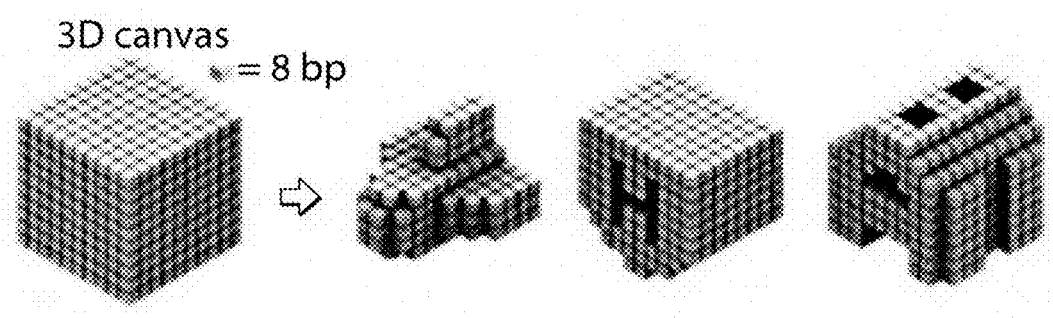
FIG. 1F is a schematic of complex arbitrary 3D shapes designed and assembled from a large 10×10×10 voxel "3D canvas." Each voxel represents a duplex of a single domain (e.g., 8 nucleotide domain) of, for example, a 4-domain oligonucleotide, formed by base-pairing of two single-stranded oligonucleotides.

Structural periodicities of the design can be illustrated in a 6H (helix)×6H (helix)×48B (base pair) cuboid nanostructure (FIGS. 1C, 1D). Bricks can be grouped in 8 base pair layers that contain their head domains. Bricks follow a 90° clockwise rotation along successive 8 base pair layers, therefore every four layers is a repeating unit in terms of orientation and arrangement of the bricks. For example, the first and fifth 8 base pair layers in FIG. 1D can share the same arrangement of bricks. Within an 8 base pair layer, all bricks can share the same orientation, and form chains with their pairs of holes defining a line. These chains pack laterally with a staggered arrangement to tile the plane defined by the layer. On the boundary of each layer, some nucleic acid bricks need to be bisected to half-bricks (i.e., 2 domain oligonucleotides), representing a single helix with two domains. The cuboid can be self-assembled from nucleic acid bricks in a one-step reaction. In some instances, each brick can carry a unique sequence that directs it to fit only to its predesigned position. Due to its modularity, a predesigned nucleic acid brick nanostructure can be used for construction of smaller custom and arbitrary shapes assembled from subsets of bricks (FIG. 1E).

The Lego-like model can be further abstracted to a 3D model that contains only positional information of each 8 bp duplex. A 10H×10H×80B cuboid is conceptualized as a 3D canvas that contains 10×10×10 voxels, each voxel corresponding to an 8 bp duplex (FIG. 1E). Based on the 3D canvas, a computer program first generates a full set of DNA bricks, including full-bricks and half-bricks, which can be used to build any custom shape. Using a 3D modeling software, designers then only need to define the target shapes by removing unwanted voxels from the 3D canvas—a process resembles 3D sculpting. Subsequently the computer program can analyze the shape and automatically chooses the correct subset of oligonucleotides (bricks) for self-assembly of the shape.

A nucleic acid structure may be designed prior to synthesis and its size, shape, complexity and modification may be prescribed and controlled by using certain select oligonucleotides in the synthesis process. The location of each domain and each oligonucleotide in the structure is known and provided for before synthesizing a nanostructure of a particular shape.

Typically, each domain of an oligonucleotide has a unique sequence. A pair of neighboring oligonucleotides form a duplex via hybridization of two complementary domains (e.g., head domain 1 and a tail domain 3), each located in one of the oligonucleotides (FIG. 1B, top). In some instances, however, certain domains of an oligonucleotide may not bind to another domain in a nucleic acid structure. In such instances, oligonucleotides having a poly-T domain are present in the structure, preferably at borders and in configurations that result in the poly-T domains being single-stranded. Thus, in some embodiments, at least one or at least two domains of a four (or more) domain oligonucleotide may be a poly-T domain (e.g., consist of T nucleotides).

In some instances, at least one domain in a nucleic acid structure will be unique, intending that the domain appears only once in that structure. A structure may be comprised of one or more unique domains, including 1, 2, 3, 4, 5, 6, 7, 8, 9, 10, 20, 30, 40, 50, 60, 70, 80, 90, 100, 200, 300, 400, 500, 600, 700, 800, 900, 1000 or more unique domains. In some embodiments, at least 10%, 20%, 30%, 40%, 50%, 60%, 70%, 80%, 80%, or 90% of the domains in the structure are unique. As an example, a structure may comprise a first plurality of domains each of which appears only once in the structure and these unique domains may present 75% of the total domains in the structure, and a second plurality of domains each of which appears more than once in the structure and these repeating domains may represent 25% of the total domains in the structure. It will be apparent that other percentages are also possible. In some embodiments, every domain in a structure is unique. In some embodiments, every domain in a structure is unique except for the poly-T domains. Every domain in a composite structure (i.e., a structure comprising two or more nucleic acid structures linked to each other with a spacer-linker) may or may not be unique.

In some instances, at least one domain in a double helix in a structure will be unique, intending that the domain appears only once in that double helix. The domain may be present in other helices within the same structure, and so in some instances, it may not be unique in the context of the entire nucleic acid structure. There may be 1, 2, 3, 4, 5, 6, 7, 8, 9, 10 or more domains in a helix that are unique in the context of that helix. The unique domains in a helix may represent at least 10%, 20%, 30%, 40%, 50%, 60%, 70%, 80%, 80%, 90%, or 100% of the domains in that helix. The unique domains in a helix may be located at or near the ends of the structure. The unique domains in a helix may be contiguous to each other or they may be spread apart from each other. They may be separated from each other by repeating domains (i.e., domains that appear more than once in a helix).

The structures may comprise one or more helices having unique domains. This type of helix may represent at least 10%, 20%, 30%, 40%, 50%, 60%, 70%, 80% or 90% or 100% of the helices present in the structure. If more than one of this helix type is present in the structure, they may be adjacent to each other or they may be separated by other helices including helices that do not contain unique domains. As an example, helices having unique domains may alternate in the structure with helices lacking unique domains.

Thus, in some instances, the nucleic acid structure may comprise two or more helices each having one or more unique domains, wherein the domain is unique in the context of an individual helix itself, and possibly unique within the context of the structure as a whole. The unique domain(s) in an individual helix may be present in other helices in the structure. The unique domain(s) in an individual helix may be the unique domain(s) in other helices in the structure.

In some instances, one or more helices in the structure each may be comprised entirely of unique domains, intending that each of those domains is present only once per helix or is present only once per structure.

Thus, in some instances, the nucleic acid structures of the invention comprise at least one unique double helix. A unique double helix is a helix having a domain composition that is different from any other helix in the structure. The unique double helix would therefore also have a nucleotide sequence that is different from any other helix in the structure.

In still other instances, the nucleic acid structures of the invention may be designed such that they comprise one region that is comprised of unique domains and another region that is comprised of non-unique or repeating domains.

The structures described may be defined, at least in part, based on a number of helices formed in an X direction, a number of helices formed in a Y direction, and a depth of such helices (indicated by the number of base pairs of such helices). It is to be understood that the helices so formed (and referred to) may be discontinuous helices (i.e., there may be double-stranded nicks in the helices along their length) since they are comprised of a plurality of hybridizing domains from separate oligonucleotides. The methods of the invention have been used to generate 3D canvases (from which a variety of arbitrarily shaped nucleic acid structures may be formed) of varying sizes including cuboids such as 3H×3H (×32b, ×64b, ×128b, ×256b, ×512b, ×1024b), 4H×4H (×32b, ×64b, ×128b, ×256b, ×512b), 6H×6H (×32b, ×64b, ×128b, ×256b), 12H×12H×48b, cylinders such as 6H×10H (×32b, ×64b, ×128b), strands such as 30H×1H× 126b, honey-comb lattices such as 6H×6H×84b-HC, and hexagonal lattices such as 6H×7H×108b-HL.

Figure 2A:
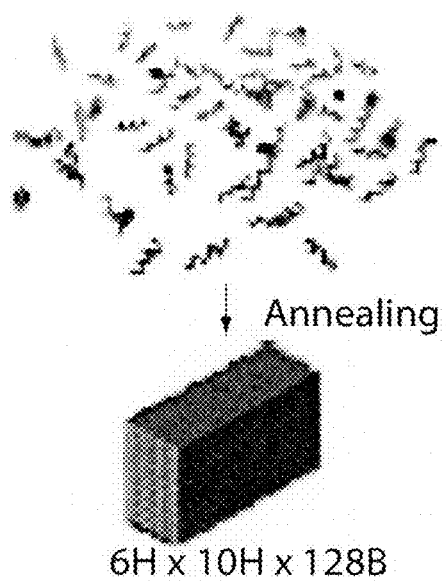
FIG. 2A is a schematic of one-step thermal annealing for self-assembly of DNA-block nanostructures.
Figure 2B:
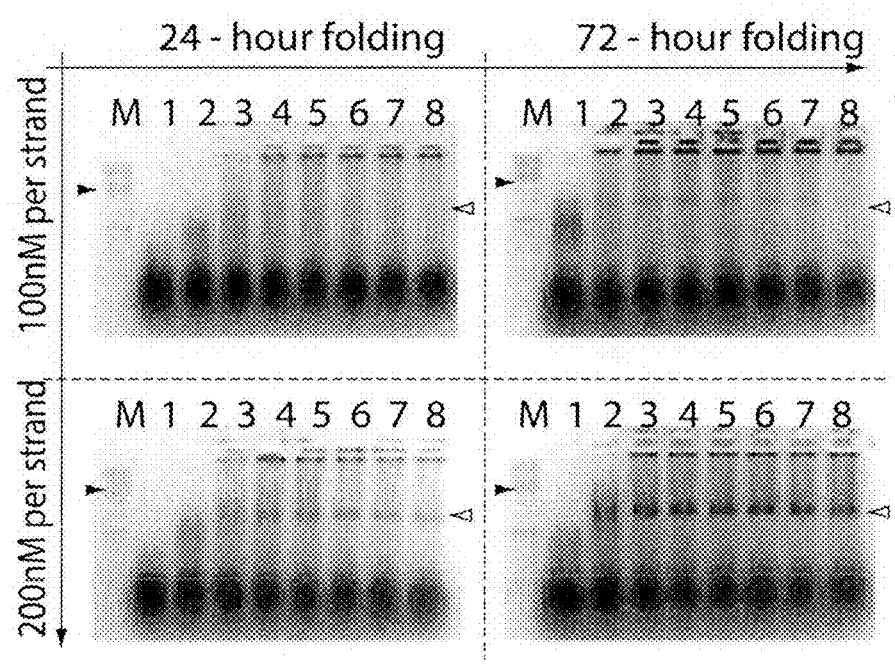
FIG. 2B shows images of agarose gel electrophoresis for a 6H×10H×128B nanostructure. The nanostructure was self-assembled at the following conditions: 24 hours or 72 hours annealing ramp, 100 nM or 200 nM for each DNA strand, 0.5×TE buffer at pH 7.9, $MgCl_2$ concentration at 10, 20, 30, 40, 50, 60, 70, or 80 mM. For each agarose gel, lane M shows a 1 kb ladder, lanes 1 to 8 show the 6H×10H×128B structure annealed with ascending $MgCl_2$ concentrations. The product bands (pointed by gray arrows) are compared to the 3 kb marker band (indicated by black arrows) to estimate the self-assembly yields of each condition. Maximum yield was achieved when 200 nM (per strand) strands were annealed for 72 hours at 40 mM $MgCl_2$.
Figure 2C:
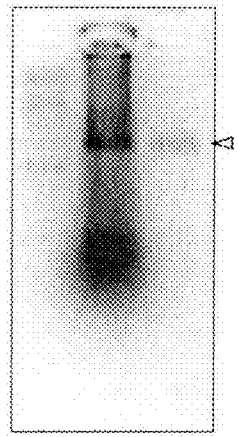
FIG. 2C shows images of agarose gel electrophoresis comparing unpurified 6H×10H×128B structures and purified 6H×10H×128B structures. Lane M shows a 1 kb ladder. Lane 1 shows unpurified 6H×10H×128B structures annealed at the optimal conditions shown in FIG. 2B and FIG. 2C. Lane 2 shows purified 6H×10H×128B structures. The gray arrow points to the 6H×10H×128B product band.
Figure 2D:
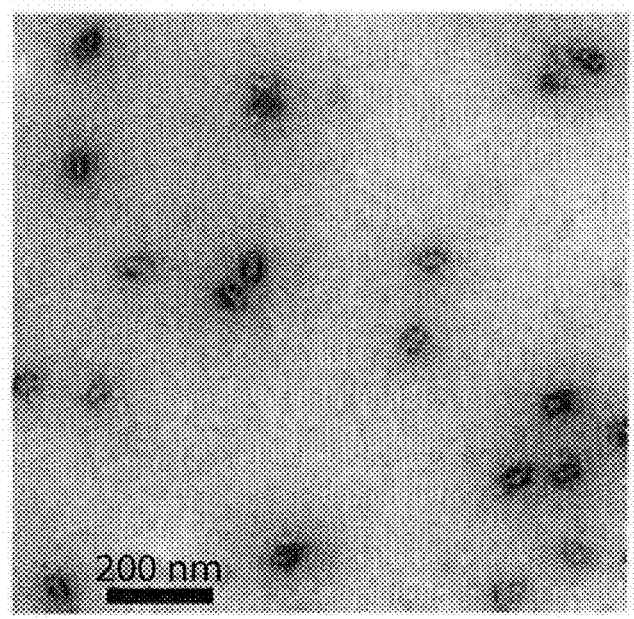
FIG. 2D shows transmission electron microscopy (TEM) images of purified 6H×10H×128B structures. Higher magnification images show three views of complete structures (also referred to herein as "particles"), corresponding to X-Y plane, X-Z plane and Y-Z plane projection of 6H×10H×128B, respectively. Computer-generated projection views are shown to the right of the high magnification TEM images.
Figure 2D:
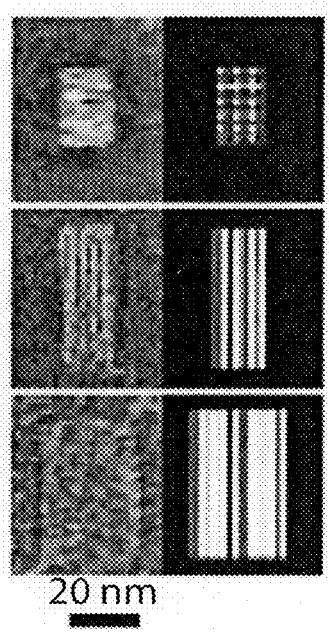
Figure 2E:
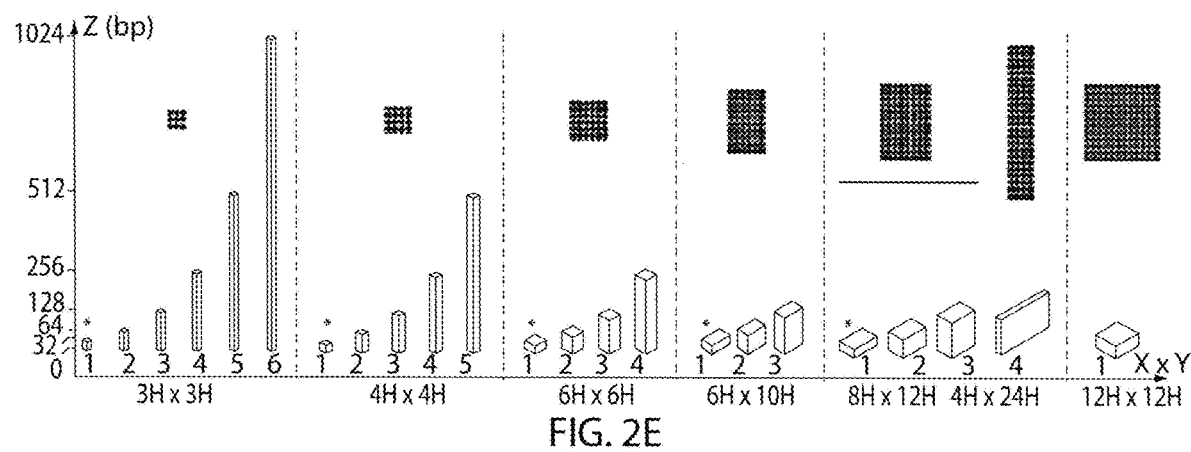
FIG. 2E shows schematic designs of 3D DNA-block nanostructures of a variety of dimensions.

The structures are formed, at least in part, by annealing a plurality of known oligonucleotides in a single vessel. FIG. 2A shows a schematic of one-step thermal annealing for self-assembly of oligonucleotide-block nanostructures. The Figure shows the schematic of the expected cuboid structure. FIG. 2D shows transmission electron microscopy (TEM) images of a purified 6H×10H×128B structure, post-annealing process. Higher magnification images show three views of complete nanostructures, corresponding to X-Y plane, X-Z plane and Y-Z plane projection of 6H×10H× 128B, respectively. Computer-generated projection views are shown to the right of the magnified TEM images. The gel electrophoresis analysis of the post-annealing process shows unpurified 6H×10H×128B structure annealed at the optimal conditions (lane 1) and purified 6H×10H×128B structure (lane 2). The gray arrow points to the 6H×10H×128B product band. Starting with a known pool of oligonucleotides that can be used to generate a three-dimensional shape of a certain size, select oligonucleotides may be excluded from the pool in order to form different shaped and/or sized structures.

Figure 3A:
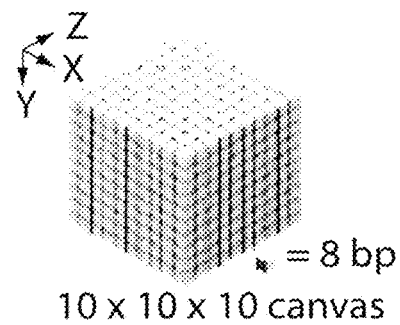
FIG. 3A is a schematic of a 10 voxel×10 voxel×10 voxel three-dimensional canvas.
Figure 3B:
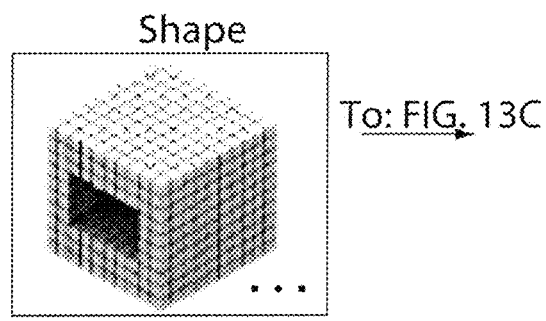
FIG. 3B is a schematic of a target nucleic acid structure designed by removing unnecessary voxels from the 3D canvas (in this case, from the interior).
Figure 3C:
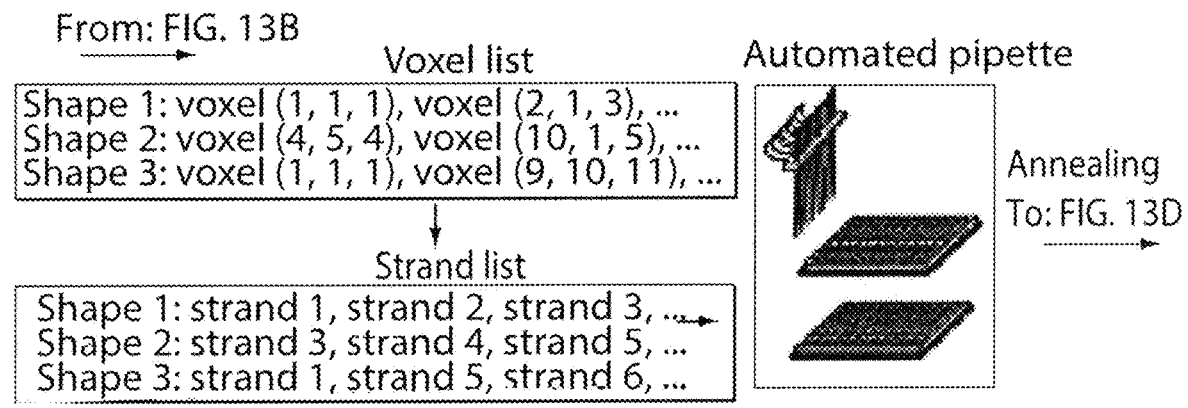
FIG. 3C is a schematic showing a computer-generated list of oligonucleotides strands needed to form the desired structure/shape. Structures were analyzed by a computer program, which recognizes the remaining voxels and generates a list of necessary oligonucleotides. A liquid handling robot then mixes strands for each shape.
Figure 3D:
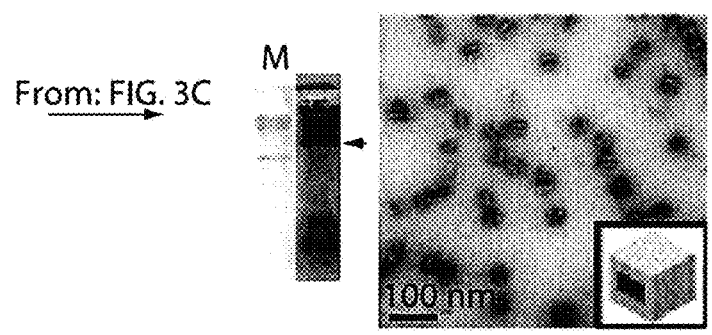
FIG. 3D shows images of nanostructures after annealing, characterized by agarose gel electrophoresis (left) and TEM imaging (right). Lane M shows a 1 kb ladder. The major product band is denoted by the arrow.
Figure 3E:
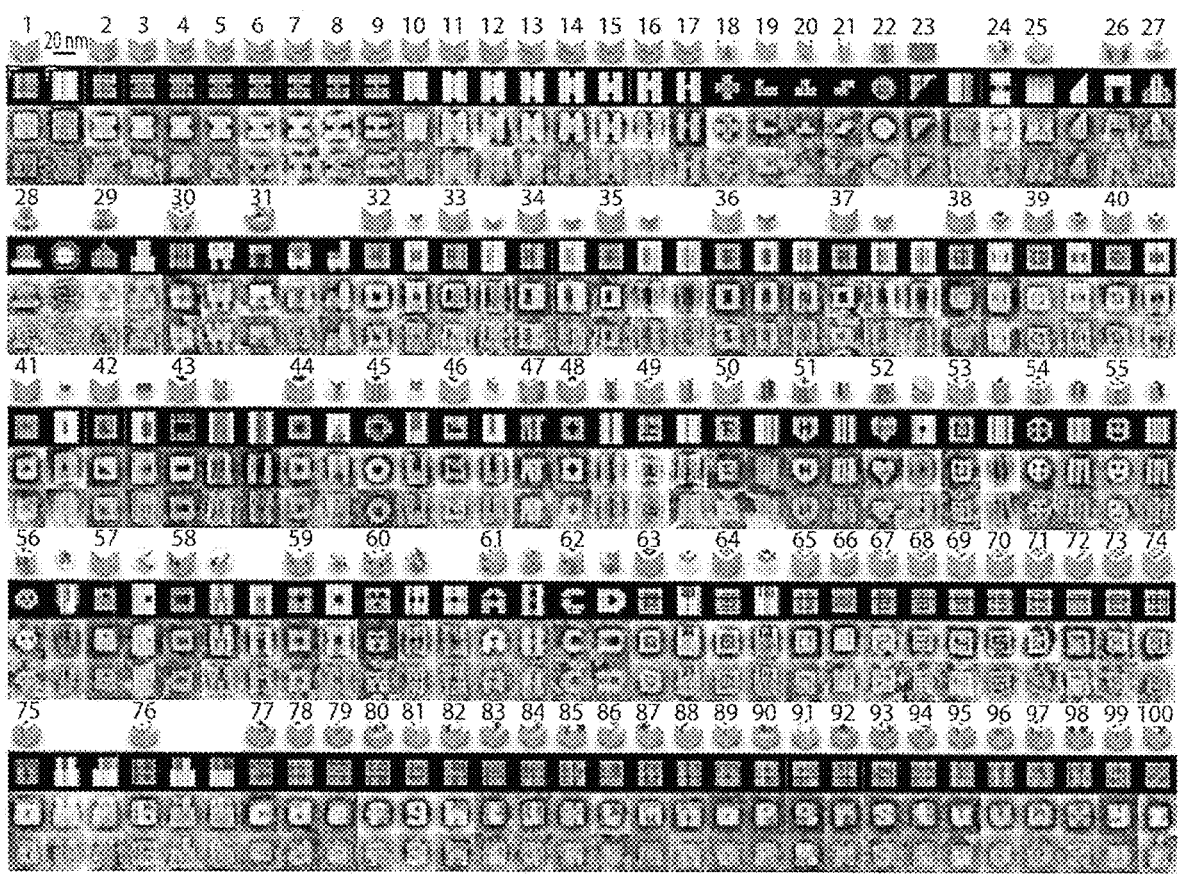
FIG. 3E shows images of various examples nanostructure (of particular shapes). The top image for each structure depicts a 3D model, followed below by computer-generated projection views. An image was averaged from 6 different structures/particles visualized using TEM and raw TEM images. Some structures are depicted with additional transparent 3D views that highlight the deleted voxels (i.e., deleted oligonucleotide domains). The individual oligonucleotide sequences used to produce the 100 different nucleic acid structures of FIG. 3E are designated SEQ ID NOs. 6842-11296 (i.e., strands 0-4454, respectively). (See also Table 14 of U.S. provisional application No. 61/675,309, filed Jul. 24, 2012, incorporated by reference herein.) Table 2 shows, for each shape, the total number of strands used and a list of each strand (bracketed). (See also Table 15 of U.S. provisional application No. 61/675,309, filed Jul. 24, 2012.)

A variety of structures that may be made using these methods are shown in FIG. 3E. Also shown are the post-annealing products resulting from such methods. The invention contemplates exclusion of oligonucleotides internal to a structure. As an example, FIG. 3B illustrates a structure having an internal void pattern (i.e., a predetermined region lacking any oligonucleotides).

Thus, in some instances, an end user designs a nucleic acid structure, such as for example a cuboid having a particular length, width and depth dimension, with knowledge of the particular oligonucleotide present at each position in the structure. In effect, the end user has a physical map that denotes the precise location of each oligonucleotide within the structure. Knowledge of the identity of each oligonucleotide at each location in the map (and thus in the nucleic acid structure) allows the end user to engineer particular patterns or shapes using a particular structure as a starting point. Such engineering can occur by excluding one or more known oligonucleotides from the mixture of oligonucleotides combined to form the nucleic acid structure and/or including additional known oligonucleotides.

Thus, as an example and as demonstrated herein, an end user may design a three dimensional cube having a particular length (Y-axis), width (X-axis) and depth (Z-axis), and comprised of a plurality of unique oligonucleotides. The end user knows the identity of the oligonucleotide at each position in the lattice. In addition to being able to synthesize the cube itself, the end user is also able to design and synthesize one or more other nucleic acid structures using the cube as a starting point. As demonstrated herein, variously shaped nucleic acid structures may be synthesized by excluding one and usually more oligonucleotides from the pool that would be used to make the entire cube. These shapes include without limitation any of the shapes depicted in FIG. 3E.

The invention therefore provides a methodology for synthesizing a number of different nucleic acid structures without having to design each structure de novo. Rather, starting with an initial nucleic acid structure, such as a cube, a variety of other nucleic acid structures may be formed simply by excluding preselected oligonucleotides and/or including preselected oligonucleotides. In this way, the end user uses the single-stranded oligonucleotides in a modular manner, including or excluding members of the plurality depending upon the ultimate shape and size of nucleic acid structure desired. The interactions between oligonucleotide members of the plurality are not expected to change appreciably and therefore it is not necessary for an end user to design, essentially from scratch, every new nucleic acid structure. Instead, the end user prepares stocks of each oligonucleotide and combines various stocks together, at relative concentrations corresponding to their relative frequency in the structure and in a single vessel, in order to form a nucleic acid structure of desired shape, size and complexity.

The selection and arrangement of single-stranded oligonucleotides in a nucleic acid structure of desired shape and size can be done manually or by computer algorithm. An example of such a computer algorithm is Uniquimer, which is openly available to the public.

As illustrated in some of the Figures herein, the size of the nucleic acid structures of the invention may be controlled during the annealing process. This size control is achieved by designing structures having one or more unique domains, or one or more unique helices and thus using select populations of oligonucleotides in the annealing process. The size of the nucleic acid structure thus is typically also predetermined.

The size of a nucleic acid structure may be represented by distance of one, two or three of its dimensions. Such dimensions may each independently be nanometers or micrometers in length, or longer. As an example, the structure may comprise one, two or three dimensions each having a length, width and/or depth in the range of 5-100 nanometers, 5-500 nanometers, 5-1000 nanometers, including 10-100 nanometers, 10-500 nanometers, or 10-1000 nanometers. In some embodiments, they may have one or more dimensions of about 5, 10, 20, 30, 40, 50, 60, 70, 80, 90, 100, 110, 120, 130, 140, 150, 160, 170, 180, 190, 200, 300, 400, 500, 600, 700, 800, 900 nm or more.

The size of the nucleic acid structure may also be presented by the number of double helices as well as the length of those double helices. The length of a double helix may be expressed as the number of helical turns in the helix. It is to be understood that the invention contemplates making structures that are in the nanometer and micrometer scale, and larger.

In some embodiments, a nucleic acid structure may comprise 2, 4, 8, 12, 16, 20, 24, 28, 32, 36, 40, 44, 48, 52, 56, 60, 64, 68, 72, 76, 80, 120, 160, 200, 240, 280, 320, or 360 helices. For example, a nucleic acid structure may be presented as a 6 helix (H)×6H×64 base pair (bp) structure (i.e., 6H×6H×64B). Other examples of structures include without limitation a 3H×3H×64B structure, a 3H×3H×128B structure, a 3H×3H×256B structure, a 3H×3H×512B structure, a 3H×3H×1024B structure, 4H×4H×64B structure, a 4H×4H×128B structure, a 4H×4H×256B structure, a 4H×4H×512B structure, a 4H×4H×1024B structure, a 6H×6H×64B structure, a 6H×6H×128B structure, a 6H×6H×256B structure, a 6H×6H×512B structure, a 6H×6H×1024B structure, 8H×8H×64B structure, a 8H×8H×128B structure, a 8H×8H×256B structure, a 8H×8H×512B structure, a 8H×8H×1024B structure, 12H×12H×64B structure, a 12H×12H×128B structure, a 12H×12H×256B structure, a 12H×12H×512B structure, or a 12H×12H×1024B structure. Additional examples include without limitation structures of 6H×10H×64B, 6H×10H×128B, 4H×12H×120B, 8H×12H×32B, 8H×12H×64B, 8H×12H×120B, 4H×24H×120B, 30H×1H×126B, 6H×7H×108B.

The nucleic acid structures of the invention may take any shape or form. Examples of various shapes and forms that may be created using the methods of the invention are illustrated in FIGS. 3A-3E, FIGS. 21A-21C, FIGS. 22A-22E and FIGS. 23A-23D. Importantly, using the methodology of the invention, it is possible to predetermine and thus predesign the shape, form and size of the nucleic acid structure with precise control based on knowledge of the identity (and thus sequence) of oligonucleotides at every location in the structure.

As discussed herein, nucleic acid structures may be synthesized by combining and annealing a plurality of single-stranded oligonucleotides in a single annealing reaction to yield a nucleic acid structure of desired shape, size, complexity and modification. The invention also contemplates synthesis of nucleic acid structures by annealing separate smaller nucleic acid structures to each other, in a modular manner.

In some embodiments, the nucleic acids and/or structures are annealed by subjecting them to an elevated temperature and then a slow cooling process. The elevated temperature may be about 50° C., about 45° C., or about 40° C., and the cooling process is intended to cool the solution to about room temperature (e.g., about 25° C.). The cooling period may be several minutes, several hours including 2, 3, 4, 5, 6, 7, 8, 9, or 10 hours, or more, including 24, 36, 48, 60, 72, 84, 96, 108, 120, 132, 144, 156 or 168 hours.

In some embodiments, the nucleic acid structures are crystal-like structures (referred to herein as "crystals"). Crystals may be assembled by using "connecting" bricks between discrete three-dimensional DNA-brick structures. In some embodiments, the assembly (also referred to as "growth") of a crystal may be non-hierarchical, while in other embodiments, the assembly of a crystal may be hierarchical. Non-hierarchical growth of a DNA brick crystal herein refers to the assembly of a crystal from individual DNA bricks, without first forming a repeating functional unit. Thus, individual DNA bricks are incorporated individually into the crystal as it grows. In such embodiments, a DNA-brick crystal may be designed based on a repeating unit where the connecting bricks are the same as the other bricks in size and function. By contrast, hierarchical growth of a DNA brick crystal herein refers to the assembly of a crystal from "pre-formed" repeating functional units (e.g., larger structures pre-formed from DNA bricks). In some embodiments, the DNA bricks on the surfaces of a discrete DNA-brick design may be modified to connect individual structures and extend the growth of crystals along the X-axis, Y-axis and Z-axis individually to generate one-dimensional-growth crystals. In some embodiments, the DNA bricks on the surfaces of a discrete DNA-brick design may be modified to connect individual structures and extend the growth of crystals along the X-axis, Y-axis and Z-axis combinatorially to generate two-dimensional-growth crystals or three-dimensional-growth crystals.

In order to achieve multimerization along the Z-axis, the sequences of the first layer of domains may be modified, in some embodiments, to be complementary to those in the last layer of domains. The multimerization along the X-axis or Y-axis may be achieved by substituting the bricks on the boundary along X-axis or Y-axis with new 32-nt bricks. Each of these new 32-nt bricks may contain two domains complementary to one side of the cuboid and another two domains complementary to the opposite side of the cuboid. Thus, these 32-nt bricks may connect the cuboid monomers to achieve continuous growth.

Figure 20A:
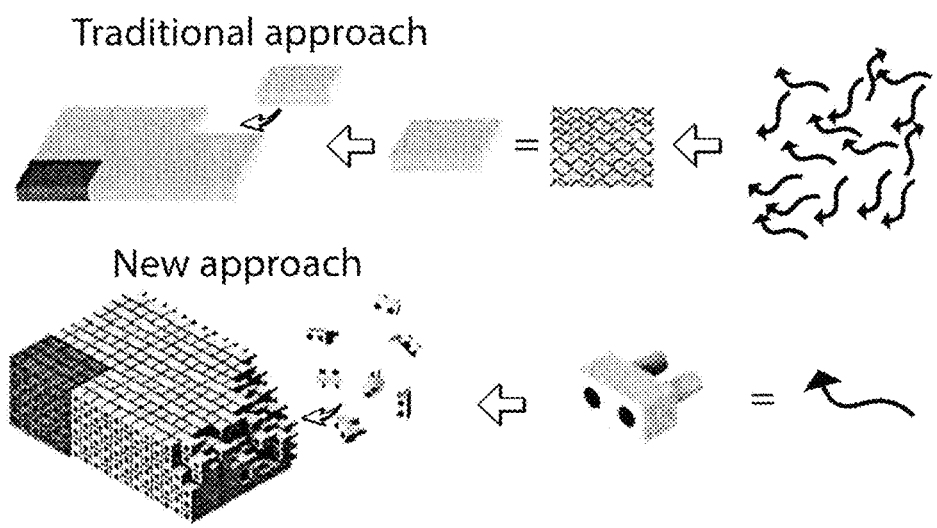
FIG. 20A shows a proposed assembly mechanism of a traditional DNA assembly approach (top) compared to a proposed assembly mechanism of a DNA crystal of the invention (bottom). Individual DNA strands, rather than pre-assembled multi-stranded blocks, are directly incorporated into a growing DNA crystal, enabling a general and robust framework for building complex crystals with prescribed depths and three-dimensional features.

As used herein, a "Z-crystal" refers to a one-dimensional crystal extended along the Z-axis. Similarly, an "X-crystal" or a "Y-crystal" refers to a one-dimensional crystal extended along the X-axis or the Y-axis, respectively. A "ZX-crystal" refers to a two-dimensional crystal extended along the Z-axis and the X-axis. An "XY-crystal" refers to a two-dimensional crystal extended along the X-axis and the Y-axis. FIG. 20F shows complex DNA crystals in three-dimensional space. Using different designs of repeating units, DNA-brick crystals with prescribed dimension(s) and pattern(s) can be made. Accordingly, a crystal design is named as "[the growth direction(s)]-[the size of the repeating unit]-[basic feature of its shape]." For example, an XY-4H×4H×64B-cuboid crystal is a two-dimensional crystal (XY-crystal) that is designed based on a repeating unit of a 4H×4H×64B cuboid. Like the discrete DNA-brick structures, sequences of DNA-brick crystals may be randomly generated, according to the teachings provided herein.

A crystal may be assembled by combining DNA bricks (purified or unpurified) at approximately equal ratios (e.g., 100 nm for each strand) in buffer (e.g., TE/MgCl$_2$), and then performing a single-step thermal annealing for 72, 84, 96, 108, 120, 132, 144, 156, 168 hours, or more.

In other embodiments, the invention contemplates staggered or sequential addition (and annealing) of structures, as compared to simultaneous mixture and annealing of all structures. Sequential addition may be particularly useful in the synthesis of more complex structures. In some instances, these and other annealing methods can be carried out either in a static environment or under flow. A flow environment allows non-annealed oligonucleotides or nucleic structures to be removed prior to the addition of subsequent components.

The invention also provides pluralities of nucleic acid structures. As used herein, the term plurality intends more than one, and may be used interchangeably with the term population. Such pluralities may comprise 10, 50, 100, 500, 1000 or more structures. Such pluralities may have varying degrees of homogeneity intending that a percentage of the nucleic acid structures in the plurality are identical to each other with respect to size, shape, complexity and/or modification. The plurality of structures therefore may be at least 20%, 30%, 40%, 50%, 60%, 70%, 80%, 90%, or 100% homogeneous in structures having a certain characteristic. As an example, a plurality of cuboid shaped structures may be at least 50% homogeneous intending that at least 50% of the structures in that plurality are cuboid shaped.

Such pluralities may be monodisperse intending that their members may be identical in terms of one or more characteristics including size, shape, complexity and/or modification. The pluralities may be monodisperse for all of these characteristics.

The degree of homogeneity (and conversely heterogeneity) in a plurality may be determined using a number of techniques, including but not limited to atomic force microscopy (AFM) or transmission electron microscopy (TEM), and gel electrophoresis. These techniques have been used to determine the degree of homogeneity in prepared populations of structures, as discussed in the Examples. Importantly, it has been found that the annealing methods provided herein reproducibly yield populations having a predominant nucleic acid structure species. Moreover, that predominant species appears identical to the species that was intended using the design and mapping approach of the invention.

As illustrated in a number of the Figures, in some instances, once a nucleic acid structure is formed, there may still be domains that are single-stranded. These may exist, for example, at the borders. Such borders are represented by the left and right borders of the structures provided in the Figures. It has been found in accordance with the invention that the nature of such domains can impact the efficiency and yield of the annealing process. More specifically, if these single-stranded regions are of a mixed nucleotide sequence, then the structures are more likely to agglomerate and yield is reduced. Such agglomeration can be reduced by manipulating the nucleotide sequence of these single-stranded regions. Specifically, single-stranded regions that are poly-T in sequence are less likely to cause agglomeration, resulting in better yields of structures. Poly-A and poly-C sequences may also be used. In some embodiments, therefore, certain single-stranded domains may be present in a structure and such domains may be identical to each other in sequence.

In certain embodiments, border regions may be comprised of a mixture of poly-T domains and other domains of mixed sequence, provided that the structures do not agglomerate substantially. In these instances, the mixed sequence domains can be used to anneal two or more structures to each other. The number of such domains may be 6, 8, 10 or more.

The structures of the invention may be modified during synthesis or post-synthesis. They may be modified during synthesis by using oligonucleotides that are modified. For example, one or more oligonucleotides used to generate a structure may be conjugated to a moiety of interest. Modified oligonucleotides may be used to generate the structures of the invention provided such modifications do not interfere with the ability of the oligonucleotide to bind to other oligonucleotides as required in order to form the desired structure. Additionally or alternatively, the structure may be modified post-synthesis.

Any modification is contemplated provided it does not interfere with the annealing of oligonucleotides to each other and it does not render the structure less stable, unless that is otherwise intended by the modification. Modification may be but is not limited to chemical or enzymatic in nature. Modification may involve the use of nucleic acid conjugated moieties. The moieties may be, without limitation, metallic, organic and inorganic in nature. The moieties may be conjugated to nucleic acids that are able to recognize and bind to oligonucleotides in the structure. Such nucleic acids may be triplex forming oligonucleotides, as an example. In other instances, one or more non-nucleic acid moieties may be attached, permanently or transiently, covalently or non-covalently, to the structures. The invention contemplates that unique and/or non-unique oligonucleotides may be modified. The oligonucleotides in a structure may themselves be conjugated to one or more domains that do not contribute to the structure but rather are used to bind moieties to the structure. It is to be understood that, since the location of each oligonucleotide and each domain in the structure can be predetermined, the location of each modification to the ultimate resulting structure can also be predetermined. In other words, knowledge of the location of each oligonucleotide in the structure facilitates the addressability of the structure.

In addition, the specification further incorporates in its entirety the appendix submitted with U.S. provisional application No. 61/675,309, filed Jul. 24, 2012, which provides various oligonucleotide sequences used to produce some of the nanostructures of the invention. The oligonucleotide sequences used to produce 6H×6H×64B-S nucleic acid structures of the invention are designated SEQ ID NOs. 1-78, 157-225 and 295-336, and the corresponding 5' end coordinates are shown respectively in Table 3A. (See also Appendix, Table 1 of U.S. provisional application No. 61/675,309, filed Jul. 24, 2012, incorporated by reference herein.)

TABLE 3A

[0, 32], [0, 64], [1, 31], [1, 47], [1, 63], [1, 79], [3, 31], [3, 47], [3, 63], [3, 79], [5, 31], [5, 47], [5, 63], [5, 79], [6, 16], [6, 48], [7, 31], [7, 47], [7, 63], [7, 79], [9, 31], [9, 47], [9, 63], [9, 79], [11, 31], [11, 47], [11, 63], [11, 79], [12, 32], [12, 64], [13, 31], [13, 47], [13, 63], [13, 79], [15, 31], [15, 47], [15, 63], [15, 79], [17, 31], [17, 47], [17, 63], [17, 79], [18, 16], [18, 48], [19, 31], [19, 47], [19, 63], [19, 79], [21, 31], [21, 47], [21, 63], [21, 79], [23, 31], [23, 47], [23, 63], [23, 79], [24, 32], [24, 64], [25, 31], [25, 47], [25, 63], [25, 79], [27, 31], [27, 47], [27, 63], [27, 79], [29, 31], [29, 47], [29, 63], [29, 79], [30, 16], [30, 48], [31, 31], [31, 47], [31, 63], [31, 79], [33, 31], [33, 47], [33, 63], [33, 79], [35, 31], [35, 47], [35, 63], [35, 79], [0, 23], [0, 39], [0, 55], [0, 71], [0, 87], [1, 24], [1, 56], [2, 23], [2, 39], [2, 55], [2, 71], [2, 87], [3, 24], [3, 56], [4, 23], [4, 39], [4, 55], [4, 71], [4, 87], [5, 24], [5, 56], [6, 23], [6, 39], [6, 55], [6, 71], [6, 87], [8, 23], [8, 39], [8, 55], [8, 71], [8, 87], [10, 23], [10, 39], [10, 55], [10, 71], [10, 87], [12, 23], [12, 39], [12, 55], [12, 71], [12, 87], [14, 23], [14, 39], [14, 55], [14, 71], [14, 87], [16, 23], [16, 39], [16, 55], [16, 71], [16, 87], [18, 23], [18, 39], [18, 55], [18, 71], [18, 87], [20, 23], [20, 39], [20, 55], [20, 71], [20, 87], [22, 23], [22, 39], [22, 55], [22, 71], [22, 87], [24, 23], [24, 39], [24, 55], [24, 71], [24, 87], [26, 23], [26, 39], [26, 55], [26, 71], [26, 87], [28, 23], [28, 39], [28, 55], [28, 71], [28, 87], [30, 23], [30, 39], [30, 55], [30, 71], [30, 87], [31, 8], [31,40], [31, 72], [32, 23], [32, 39], [32, 55], [32, 71], [32, 87], [33, 8], [33, 40], [33, 72], [34, 23], [34, 39], [34, 55], [34, 71], [34, 87], [35, 8], [35, 40], [35, 72]

The oligonucleotide sequences used to produce 6H×6H×64B nucleic acid structures of the invention are designated SEQ ID NOs. 79-156 and 226-294, and the corresponding 5' end coordinates are shown respectively in Table 3B. (See also Appendix, Table 1 of U.S. provisional application No. 61/675,309, filed Jul. 24, 2012, incorporated by reference herein.)

Random oligonucleotide sequences used to produce 6H×6H×64B nucleic acid structures of the invention are designated SEQ ID NOs. 591-737, and the corresponding 5' end coordinates are shown respectively in Table 5A. (See also Appendix, Table 3 of U.S. provisional application No. 61/675,309, filed Jul. 24, 2012, incorporated by reference herein.)

TABLE 3B

[0, 23], [0, 55], [0, 87], [1, 31], [1, 47], [1, 63], [1, 79], [2, 23], [2, 55], [2, 87], [3, 31], [3, 47], [3, 63], [3, 79], [4, 23], [4, 55], [4, 87], [5, 47], [5, 79], [6, 16], [6, 23], [6, 39], [6, 55], [6, 71], [6, 87], [7, 31], [7, 47], [7, 63], [7, 79], [8, 23], [8, 39], [8, 55], [8, 71], [8, 87], [9, 31], [9, 47], [9, 63], [9, 79], [10, 23], [10, 39], [10, 55], [10, 71], [10, 87], [11, 31], [11, 63], [11, 79], [12, 23], [12, 39], [12, 55], [12, 71], [12, 87], [13, 31], [13,47], [13, 63], [13, 79], [14, 23], [14, 39], [14, 55], [14, 71], [14, 87], [15, 31], [15, 47], [15, 63], [15, 79], [16, 23], [16, 39], [16, 55], [16, 71], [16, 87], [17, 47], [17, 79], [18, 16], [18, 23], [18, 39], [18, 55], [18, 71], [18, 87], [19, 31], [19, 47], [19, 63], [19, 79], [20, 23], [20, 39], [20, 55], [20, 71], [20, 87], [21, 31], [21, 47], [21, 63], [21, 79], [22, 23], [22, 39], [22, 55], [22, 71], [22, 87], [23, 31], [23, 63], [23, 79], [24, 23], [24, 39], [24, 55], [24, 71], [24, 87], [25, 31], [25, 47], [25, 63], [25, 79], [26, 23], [26, 39], [26, 55], [26, 71], [26, 87], [27, 31], [27, 47], [27, 63], [27, 79], [28, 23], [28, 39], [28, 55], [28, 71], [28, 87], [29, 47], [29, 79], [30, 16], [30, 39], [30, 71], [30, 87], [31, 8], [31, 31], [31, 47], [31, 63], [31, 79], [32, 39], [32, 71], [32, 87], [33, 8], [33, 31], [33, 47], [33, 63], [33, 79], [34, 39], [34, 71], [34, 87], [35, 8], [35, 31], [35, 63], [35, 79]

The oligonucleotide sequences used to produce 6H×10H×64B-M nucleic acid structures of the invention are designated SEQ ID NOs. 337-590, and the corresponding 5' end coordinates are shown respectively in Table 4. (See also Appendix, Table 2 of U.S. provisional application No. 61/675,309, filed Jul. 24, 2012, incorporated by reference herein.)

TABLE 5A

[1, 31], [1, 47], [1, 63], [1, 79], [3, 31], [3, 47], [3, 63], [3, 79], [5, 47], [5, 79], [6, 16], [7, 31], [7, 47], [7, 63], [7, 79], [9, 31], [9, 47], [9, 63], [9, 79], [11, 31], [11, 63], [11, 79], [13, 31], [13, 47], [13, 63], [13, 79], [15, 31], [15, 47], [15, 63], [15, 79], [17, 47], [17, 79], [18, 16], [19, 31], [19, 47], [19, 63], [19, 79],

TABLE 4

[1, 23], [1, 55], [1, 39], [1, 71], [3, 23], [3, 55], [3, 39], [3, 71], [5, 39], [5, 71], [6, 56], [6, 8], [6, 24], [8, 24], [8, 56], [8, 8], [8, 40], [10, 24], [10, 56], [10, 8], [10, 40], [11, 71], [13, 23], [13, 55], [13, 39], [13, 71], [15, 23], [15, 55], [15, 39], [15, 71], [17, 39], [17, 71], [18, 56], [18, 8], [18, 24], [20, 24], [20, 56], [20, 8], [20, 40], [22, 24], [22, 56], [22, 8], [22, 40], [23, 71], [25, 23], [25, 55], [25, ,39], [25, 71], [27, 23], [27, 55], [27, 39], [27, 71], [29, 39], [29, 71], [30, 56], [30, 8], [30, 24], [32, 24], [32, 56], [32, 8], [32, 40], [34, 24], [34, 56],

[34, 8], [34, 40], [35, 71], [37, 23], [37, 55], [37, 39], [37, 71], [39, 23], [39, 55], [39, 39], [39, 71], [41, 39], [41, 71], [42, 56], [42, 8], [42, 24], [44, 24], [44, 56], [44, 8], [44, 40], [46, 24], [46, 56], [46, 8], [46, 40], [47, 71], [49, 23], [49, 55], [49, 39], [49, 71], [51, 23], [51, 55], [51, 39], [51, 71], [53, 39], [53, 71], [54, 56], [54, 8], [54, 24], [56, 24], [56, 56], [56, 8], [56, 40], [58, 24], [58, 56], [58, 8],

[58, 40], [59, 71], [0, 15], [1, 64], [2, 15], [3, 64], [4, 15], [5, 64], [0, 47], [0, 79], [1, 0], [1, 32], [2, 47], [2, 79], [3, 0], [3, 32], [4, 47], [4, 79], [5, 0], [5, 32], [12, 15], [12, 47], [12, 79], [13, 0], [13, 32], [13, 64], [14, 15], [14,47], [14, 79], [15, 0], [15, 32], [15, 64], [16, 15], [16, 47], [16, 79], [17, 0], [17, 32], [17, 64], [12, 31], [12, 63], [13, 16], [13, 48], [14, 31], [14, 63], [15, 16], [15, 48], [16, 31], [16, 63], [17, 16], [17, 48], [24, 15], [24, 47], [24, 79], [25, 0], [25, 32], [25, 64], [26, 15], [26,47], [26, 79], [27, 0], [27, 32], [27, 64], [28, 15], [28, 47], [28, 79], [29, 0], [29, 32], [29, 64], [24, 31], [24, 63], [25, 16], [25, 48], [26, 31], [26, 63], [27, 16], [27, 48], [28, 31], [28, 63], [29, 16], [29, 48], [36, 15], [36, 47], [36, 79], [37, 0], [37, 32], [37, 64], [38, 15], [38, 47], [38, 79], [39, 0], [39, 32], [39, 64], [40, 15], [40, 47], [40, 79], [41, 0], [41, 32], [41, 64], [36, 31], [36, 63], [37, 16], [37, 48], [38, 31], [38, 63], [39, 16], [39, 48], [40, 31], [40, 63], [41, 16], [41, 48], [48, 15], [48, 47], [48, 79], [49, 0], [49, 32], [49, 64], [50, 15], [50, 47], [50, 79], [51, 0], [51, 32], [51, 64], [52, 15], [52, 47], [52, 79], [53, 0], [53, 32], [53, 64], [48, 31], [48, 63], [49, 16], [49, 48], [50, 31], [50, 63], [51, 16], [51, 48], [52, 31], [52, 63], [53, 16], [53, 48], [54, 79], [55, 0], [56, 79], [57, 0], [58, 79], [59, 0]

TABLE 5A-continued

[21, 31], [21, 47], [21, 63], [21, 79], [23, 31], [23, 63], [23, 79], [25, 31], [25, 47], [25, 63], [25, 79], [27, 31], [27, 47], [27, 63], [27, 79], [29, 47], [29, 79], [30, 16], [31, 31], [31, 47], [31, 63], [31, 79], [33, 31], [33, 47], [33, 63], [33, 79], [35, 31], [35, 63], [35, 79], [0, 23], [0, 55], [0, 87], [2, 23], [2, 55], [2, 87], [4, 23], [4, 55], [4, 87], [6, 23], [6, 39], [6, 55], [6, 71], [6, 87], [8, 23], [8, 39], [8, 55], [8, 71], [8, 87], [10, 23], [10, 39], [10, 55], [10, 71], [10, 87], [12, 23], [12, 39], [12, 55], [12, 71], [12, 87], [14, 23], [14, 39], [14, 55], [14, 71], [14, 87], [16, 23], [16, 39], [16, 55], [16, 71], [16, 87], [18, 23], [18, 39], [18, 55], [18, 71], [18, 87], [20, 23], [20, 39], [20, 55], [20, 71], [20, 87], [22, 23], [22, 39], [22, 55], [22, 71], [22, 87], [24, 23], [24, 39], [24, 55], [24, 71], [24, 87], [26, 23], [26, 39], [26, 55], [26, 71], [26, 87], [28, 23], [28, 39], [28, 55], [28, 71], [28, 87], [30, 39], [30, 71], [30, 87], [31, 8], [32, 39], [32, 71], [32, 87], [33, 8], [34, 39], [34, 71], [34, 87], [35, 8]

Designed oligonucleotide sequences used to produce 6H×6H×64B nucleic acid structures of the invention are designated SEQ ID NOs. 738-884, and the corresponding 5' end coordinates are shown respectively in Table 5B. (See also Appendix, Table 3 of U.S. provisional application No. 61/675,309, filed Jul. 24, 2012, incorporated by reference herein.)

TABLE 5B

[1, 31], [1, 47], [1, 63], [1, 79], [3, 31], [3, 47], [3, 63], [3, 79], [5, 47], [5, 79], [6, 16], [7, 31], [7, 47], [7, 63], [7, 79], [9, 31], [9, 47], [9, 63], [9, 79], [11, 31], [11, 63], [11, 79], [13, 31], [13, 47], [13, 63], [13, 79], [15, 31], [15,47], [15, 63], [15, 79], [17,47], [17, 79], [18, 16], [19, 31], [19, 47], [19, 63], [19, 79], [21, 31], [21, 47], [21, 63], [21, 79], [23, 31], [23, 63], [23, 79], [25, 31], [25, 47], [25, 63], [25, 79], [27, 31], [27, 47], [27, 63], [27, 79], [29, 47], [29, 79], [30, 16], [31, 31], [31, 47], [31, 63], [31, 79], [33, 31], [33, 47], [33, 63], [33, 79], [35, 31], [35, 63], [35, 79], [0, 23], [0, 55], [0, 87], [2, 23], [2, 55], [2, 87], [4, 23], [4, 55], [4, 87], [6, 23], [6, 39], [6, 55], [6, 71], [6, 87], [8, 23], [8, 39], [8, 55], [8, 71], [8, 87], [10, 23], [10, 39], [10, 55], [10, 71], [10, 87], [12, 23], [12, 39], [12, 55], [12, 71], [12, 87], [14, 23], [14, 39], [14, 55], [14, 71], [14, 87], [16, 23], [16, 39], [16, 55], [16, 71], [16, 87], [18, 23], [18, 39], [18, 55], [18, 71], [18, 87], [20, 23], [20, 39], [20, 55], [20, 71], [20, 87], [22, 23], [22, 39], [22, 55], [22, 71], [22, 87], [24, 23], [24, 39], [24, 55], [24, 71], [24, 87], [26, 23], [26, 39], [26, 55], [26, 71], [26, 87], [28, 23], [28, 39], [28, 55], [28, 71], [28, 87], [30, 39], [30, 71], [30, 87], [31, 8], [32, 39], [32, 71], [32, 87], [33, 8], [34, 39], [34, 71], [34, 87], [35, 8]

One set of oligonucleotide sequences used to produce 4H×12H×120B nucleic acid structures of the invention are designated SEQ ID NOs. 885-1220, and the corresponding 5' end coordinates are shown respectively in Table 6A. (See also Appendix, Table 4 of U.S. provisional application No. 61/675,309, filed Jul. 24, 2012, incorporated by reference herein.)

TABLE 6A

[1, 23], [1, 39], [1, 55], [1, 71], [1, 87], [1, 103], [1, 119], [1, 135], [3, 39], [3, 71], [3, 103], [3, 135], [4, 8], [5, 23], [5, 39], [5, 55], [5, 71], [5, 87], [5, 103], [5, 119], [5, 135], [7, 23], [7, 55], [7, 87], [7, 119], [7, 135], [9, 23], [9, 39], [9, 55], [9, 71], [9, 87], [9, 103], [9, 119], [9, 135], [11, 39], [11, 71], [11, 103], [11, 135], [12, 8], [13, 23], [13, 39], [13, 55], [13, 71], [13, 87], [13, 103], [13, 119], [13, 135], [15, 23], [15, 55], [15, 87], [15, 119], [15, 135], [17, 23], [17, 39], [17, 55], [17, 71], [17, 87], [17, 103], [17, 119], [17, 135], [19, 39], [19, 71], [19, 103], [19, 135], [20, 8], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 39], [27, 71], [27, 103], [27, 135], [28, 8], [29, 23], [29, 39], [29, 55], [29, 71], [29, 87], [29, 103], [29, 119], [29, 135], [31, 23], [31, 55], [31, 87], [31, 119], [31, 135], [33, 23], [33, 39], [33, 55], [33, 71], [33, 87], [33, 103], [33, 119], [33, 135], [35, 39], [35, 71], [35, 103], [35, 135], [36, 8], [37, 23], [37, 39], [37, 55], [37, 71], [37, 87], [37, 103], [37, 119], [37, 135], [39, 23], [39, 55], [39, 87], [39, 119], [39, 135], [41, 23], [41, 39], [41, 55], [41, 71], [41, 87], [41, 103], [41, 119], [41, 135], [43, 39], [43, 71], [43, 103], [43, 135], [44, 8], [45, 23], [45, 39], [45, 55], [45, 71], [45, 87], [45, 103], [45, 119], [45, 135], [47, 23], [47, 55], [47, 87], [47, 119], [47, 135], [0, 47], [0, 79], [0, 111], [0, 143], [1, 16], [2, 47], [2, 79], [2, 111], [2, 143], [3, 16], [4, 31], [4, 47], [4, 63], [4, 79], [4, 95], [4, 111], [4, 127], [4, 143], [6, 31], [6, 47], [6, 63], [6, 79], [6, 95], [6, 111], [6, 127], [6, 143], [8, 31], [8, 47], [8, 63], [8, 79], [8, 95], [8, 111], [8, 127], [8, 143], [10, 31], [10, 47], [10, 63], [10, 79], [10, 95], [10, 111], [10, 127], [10, 143], [12, 31], [12, 47], [12, 63], [12, 79], [12, 95], [12, 111], [12, 127], [12, 143], [14, 31], [14, 47], [14, 63], [14, 79], [14, 95], [14, 111], [14, 127], [14, 143], [16, 31], [16, 47], [16, 63], [16, 79], [16, 95], [16, 111], [16, 127], [16, 143], [18, 31], [18, 47], [18, 63], [18, 79], [18, 95], [18, 111], [18, 127], [18, 143], [20, 31], [20, 47], [20, 63], [20, 79], [20, 95], [20, 111], [20, 127], [20, 143], [22, 31], [22, 47], [22, 63], [22, 79], [22, 95], [22, 111], [22, 127], [22, 143], [24, 31], [24, 47], [24, 63], [24, 79], [24, 95], [24, 111], [24, 127], [24, 143], [26, 31], [26, 47], [26, 63], [26, 79], [26, 95], [26, 111], [26, 127], [26, 143], [28, 31], [28, 47], [28, 63], [28, 79], [28, 95], [28, 111], [28, 127], [28, 143], [30, 31], [30, 47], [30, 63], [30, 79], [30, 95], [30, 111], [30, 127], [30, 143], [32, 31], [32, 47], [32, 63], [32, 79], [32, 95], [32, 111], [32, 127], [32, 143], [34, 31], [34, 47], [34, 63], [34, 79], [34, 95], [34, 111], [34, 127], [34, 143], [36, 31], [36, 47], [36, 63], [36, 79], [36, 95], [36, 111], [36, 127], [36, 143], [38, 31], [38, 47], [38, 63], [38, 79], [38, 95], [38, 111], [38, 127], [38, 143], [40, 31], [40, 47], [40, 63], [40, 79], [40, 95], [40, 111], [40, 127], [40, 143], [42, 31], [42, 47], [42, 63], [42, 79], [42, 95], [42, 111], [42, 127], [42, 143], [44, 31], [44, 63], [44, 95], [44, 127], [44, 143], [46, 31], [46, 63], [46, 95], [46, 127], [46, 143]

Another set of oligonucleotide sequences used to produce 4H×12H×120B nucleic acid structures of the invention are designated SEQ ID NOs. 1221-1556, and the corresponding 5' end coordinates are shown respectively in Table 6B. (See also Appendix, Table 4 of U.S. provisional application No. 61/675,309, filed Jul. 24, 2012, incorporated by reference herein.)

TABLE 6B

[1, 23], [1, 39], [1, 55], [1, 71], [1, 87], [1, 103], [1, 119], [1, 135], [3, 39], [3, 71], [3, 103], [3, 135], [4, 8], [5, 23], [5, 39], [5, 55], [5, 71], [5, 87], [5, 103], [5, 119], [5, 135], [7, 23], [7, 55], [7, 87], [7, 119], [7, 135], [9, 23], [9, 39], [9, 55], [9, 71], [9, 87], [9, 103], [9, 119], [9, 135], [11, 39], [11, 71], [11, 103], [11, 135], [12, 8], [13, 23], [13, 39], [13, 55], [13, 71], [13, 87], [13, 103], [13, 119], [13, 135], [15, 23], [15, 55], [15, 87], [15, 119], [15, 135], [17, 23], [17, 39], [17, 55], [17, 71], [17, 87], [17, 103], [17, 119], [17, 135], [19, 39], [19, 71], [19, 103], [19, 135], [20, 8], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 39], [27, 71], [27, 103], [27, 135], [28, 8], [29, 23], [29, 39], [29, 55], [29, 71], [29, 87], [29, 103], [29, 119], [29, 135], [31, 23], [31, 55], [31, 87], [31, 119], [31, 135], [33, 23], [33, 39], [33, 55], [33, 71], [33, 87], [33, 103], [33, 119], [33, 135], [35, 39], [35, 71], [35, 103], [35, 135], [36, 8], [37, 23], [37, 39], [37, 55], [37, 71], [37, 87], [37, 103], [37, 119], [37, 135], [39, 23], [39, 55], [39, 87], [39, 119], [39, 135], [41, 23], [41, 39], [41, 55], [41, 71], [41, 87], [41, 103], [41, 119], [41, 135], [43, 39], [43, 71], [43, 103], [43, 135], [44, 8], [45, 23], [45, 39], [45, 55], [45, 71], [45, 87], [45, 103], [45, 119], [45, 135], [47, 23], [47, 55], [47, 87], [47, 119], [47, 135], [0, 47], [0, 79], [0, 111], [0, 143], [1, 16], [2, 47], [2, 79], [2, 111], [2, 143], [3, 16], [4, 31], [4, 47], [4, 63], [4, 79], [4, 95], [4, 111], [4, 127], [4, 143], [6, 31], [6, 47], [6, 63], [6, 79], [6, 95], [6, 111], [6, 127], [6, 143], [8, 31], [8, 47], [8, 63], [8, 79], [8, 95], [8, 111], [8, 127], [8, 143], [10, 31], [10, 47], [10, 63], [10, 79], [10, 95], [10, 111], [10, 127], [10, 143], [12, 31], [12, 47], [12, 63], [12, 79], [12, 95], [12, 111], [12, 127], [12, 143], [14, 31], [14, 47], [14, 63], [14, 79], [14, 95], [14, 111], [14, 127], [14, 143], [16, 31], [16, 47], [16, 63], [16, 79], [16, 95], [16, 111], [16, 127], [16, 143], [18, 31], [18, 47], [18, 63], [18, 79], [18, 95], [18, 111], [18, 127], [18, 143], [20, 31], [20, 47], [20, 63], [20, 79], [20, 95], [20, 111], [20, 127], [20, 143], [22, 31], [22, 47], [22, 63], [22, 79], [22, 95], [22, 111], [22, 127], [22, 143], [24, 31], [24, 47], [24, 63], [24, 79], [24, 95], [24, 111], [24, 127], [24, 143], [26, 31], [26, 47], [26, 63], [26, 79], [26, 95], [26, 111], [26, 127], [26, 143], [28, 31], [28, 47], [28, 63], [28, 79], [28, 95], [28, 111], [28, 127], [28, 143], [30, 31], [30, 47], [30, 63], [30, 79], [30, 95], [30, 111], [30, 127], [30, 143], [32, 31], [32, 47], [32, 63], [32, 79], [32, 95], [32, 111], [32, 127], [32, 143], [34, 31], [34, 47], [34, 63], [34, 79], [34, 95], [34, 111], [34, 143], [36, 31], [36, 47], [36, 63], [36, 79], [36, 95], [36, 111], [36, 127], [36, 143], [38, 31], [38, 47], [38, 63], [38, 79], [38, 95], [38, 111], [38, 127], [38, 143], [40, 31], [40, 47], [40, 63], [40, 79], [40, 95], [40, 111], [40, 127], [40, 143], [42, 31], [42, 47], [42, 63], [42, 79], [42, 95], [42, 111], [42, 127], [42, 143], [44, 31], [44, 63], [44, 95], [44, 127], [44, 143], [46, 31], [46, 63], [46, 95], [46, 127], [46, 143]

Yet another set of oligonucleotide sequences used to produce 4H×12H×120B nucleic acid structures of the invention are designated SEQ ID NOs.1557-1892, and the corresponding 5' end coordinates are shown respectively in Table 6C. (See also Appendix, Table 4 of U.S. provisional application No. 61/675,309, filed Jul. 24, 2012, incorporated by reference herein.)

TABLE 6C

[1, 23], [1, 39], [1, 55], [1, 71], [1, 87], [1, 103], [1, 119], [1, 135], [3, 39], [3, 71], [3, 103], [3, 135], [4, 8], [5, 23], [5, 39], [5, 55], [5, 71], [5, 87], [5, 103], [5, 119], [5, 135], [7, 23], [7, 55], [7, 87], [7, 119], [7, 135], [9, 23], [9, 39], [9, 55], [9, 71], [9, 87], [9, 103], [9, 119], [9, 135], [11, 39], [11, 71], [11, 103], [11, 135], [12, 8], [13, 23], [13, 39], [13, 55], [13, 71], [13, 87], [13, 103], [13, 119], [13, 135], [15, 23], [15, 55], [15, 87], [15, 119], [15, 135], [17, 23], [17, 39], [17, 55], [17, 71], [17, 87], [17, 103], [17, 119], [17, 135], [19, 39], [19, 71], [19, 103], [19, 135], [20, 8], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 39], [27, 71], [27, 103], [27, 135], [28, 8], [29, 23], [29, 39], [29, 55], [29, 71], [29, 87], [29, 103], [29, 119], [29, 135], [31, 23], [31, 55], [31, 87], [31, 119], [31, 135], [33, 23], [33, 39], [33, 55], [33, 71], [33, 87], [33, 103], [33, 119], [33, 135], [35, 39], [35, 71], [35, 103], [35, 135], [36, 8], [37, 23], [37, 39], [37, 55], [37, 71], [37, 87], [37, 103], [37, 119], [37, 135], [39, 23], [39, 55], [39, 87], [39, 119], [39, 135], [41, 23], [41, 39], [41, 55], [41, 71], [41, 87], [41, 103], [41, 119], [41, 135], [43, 39], [43, 71], [43, 103], [43, 135], [44, 8], [45, 23], [45, 39], [45, 55], [45, 71], [45, 87], [45, 103], [45, 119], [45, 135], [47, 23], [47, 55], [47, 87], [47, 119], [47, 135], [0, 47], [0, 79], [0, 111], [0, 143], [1, 16], [2, 47], [2, 79], [2, 111], [2, 143], [3, 16], [4, 31], [4, 47], [4, 63], [4, 79], [4, 95], [4, 111], [4, 127], [4, 143], [6, 31], [6, 47], [6, 63], [6, 79], [6, 95], [6, 111], [6, 127], [6, 143], [8, 31], [8, 47], [8, 63], [8, 79], [8, 95], [8, 111], [8, 127], [8, 143], [10, 31], [10, 47], [10, 63], [10, 79], [10, 95], [10, 111], [10, 127], [10, 143], [12, 31], [12, 47], [12, 63], [12, 79], [12, 95], [12, 111], [12, 127], [12, 143], [14, 31], [14, 47], [14, 63], [14, 79], [14, 95], [14, 111], [14, 127], [14, 143], [16, 31], [16, 47], [16, 63], [16, 79], [16, 95], [16, 111], [16, 127], [16, 143], [18, 31], [18, 47], [18, 63], [18, 79], [18, 95], [18, 111], [18, 127], [18, 143], [20, 31], [20, 47], [20, 63], [20, 79], [20, 95], [20, 111], [20, 127], [20, 143], [22, 31], [22, 47], [22, 63], [22, 79], [22, 95], [22, 111], [22, 127], [22, 143], [24, 31], [24, 47], [24, 63], [24, 79], [24, 95], [24, 111], [24, 127], [24, 143], [26, 31], [26, 47], [26, 63], [26, 79], [26, 95], [26, 111], [26, 127], [26, 143], [28, 31], [28, 47], [28, 63], [28, 79], [28, 95], [28, 111], [28, 127], [28, 143], [30, 31], [30, 47], [30, 63], [30, 79], [30, 95], [30, 111], [30, 127], [30, 143], [32, 31], [32, 47], [32, 63], [32, 79], [32, 95], [32, 111], [32, 127], [32, 143], [34, 31], [34, 47], [34, 63], [34, 79], [34, 95], [34, 111], [34, 143], [36, 31], [36, 47], [36, 63], [36, 79], [36, 95], [36, 111], [36, 127], [36, 143], [38, 31], [38, 47], [38, 63], [38, 79], [38, 95], [38, 111], [38, 127], [38, 143], [40, 31], [40, 47], [40, 63], [40, 79], [40, 95], [40, 111], [40, 127], [40, 143], [42, 31], [42, 47], [42, 63], [42, 79], [42, 95], [42, 111], [42, 127], [42, 143], [44, 31], [44, 63], [44, 95], [44, 127], [44, 143], [46, 31], [46, 63], [46, 95], [46, 127], [46, 143]

The oligonucleotide sequences used to produce 6H×10H×128B nucleic acid structures of the invention are designated SEQ ID NOs. 1893-2351, and the corresponding 5' end coordinates are shown respectively in Table 7. (See also Appendix, Table 5 of U.S. provisional application No. 61/675,309, filed Jul. 24, 2012, incorporated by reference herein.)

TABLE 7

[1, 23], [1, 39], [1, 55], [1, 71], [1, 87], [1, 103], [1, 119], [1, 135], [3, 23], [3, 39], [3, 55], [3, 71], [3, 87], [3, 103], [3, 119], [3, 135], [5, 39], [5, 71], [5, 103], [5, 135], [6, 8], [7, 23], [7, 39], [7, 55], [7, 71], [7, 87], [7, 103], [7, 119], [7, 135], [9, 23], [9, 39], [9, 55], [9, 71], [9, 87], [9, 103], [9, 119], [9, 135], [11, 23], [11, 55], [11, 87], [11, 119], [11, 135], [13, 23], [13, 39], [13, 55], [13, 71], [13, 87], [13, 103], [13, 119], [13, 135], [15, 23], [15, 39], [15, 55], [15, 71], [15, 87], [15, 103], [15, 119], [15, 135], [17, 39], [17, 71], [17, 103], [17, 135], [18, 8], [19, 23], [19, 39], [19, 55], [19, 71], [19, 87], [19, 103], [19, 119], [19, 135], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 23], [27, 39], [27, 55], [27, 71], [27, 87], [27, 103], [27, 119], [27, 135], [29, 39], [29, 71],

TABLE 7-continued

[29, 103], [29, 135], [30, 8], [31, 23], [31, 39], [31, 55], [31, 71], [31, 87], [31, 103], [31, 119], [31, 135], [33, 23], [33, 39], [33, 55], [33, 71], [33, 87], [33, 103], [33, 119], [33, 135], [35, 23], [35, 55], [35, 87], [35, 119], [35, 135], [37, 23], [37, 39], [37, 55], [37, 71], [37, 87], [37, 103], [37, 119], [37, 135], [39, 23], [39, 39], [39, 55], [39, 71], [39, 87], [39, 103], [39, 119], [39, 135], [41, 39], [41, 71], [41, 103], [41, 135], [42, 8], [43, 23], [43, 39], [43, 55], [43, 71], [43, 87], [43, 103], [43, 119], [43, 135], [45, 23], [45, 39], [45, 55], [45, 71], [45, 87], [45, 103], [45, 119], [45, 135], [47, 23], [47, 55], [47, 87], [47, 119], [47, 135], [49, 23], [49, 39], [49, 55], [49, 71], [49, 87], [49, 103], [49, 119], [49, 135], [51, 23], [51, 39], [51, 55], [51, 71], [51, 87], [51, 103], [51, 119], [51, 135], [53, 39], [53, 71], [53, 103], [53, 135], [54, 8], [55, 23], [55, 39], [55, 55], [55, 71], [55, 87], [55, 103], [55, 119], [55, 135], [57, 23], [57, 39], [57, 55], [57, 71], [57, 87], [57, 103], [57, 119], [57, 135], [59, 23], [59, 55], [59, 87], [59, 119], [59, 135], [0, 15], [0, 47], [0, 79], [0, 111], [0, 143], [2, 15], [2, 47], [2, 79], [2, 111], [2, 143], [4, 15], [4, 47], [4, 79], [4, 111], [4, 143], [6, 15], [6, 31], [6, 47], [6, 63], [6, 79], [6, 95], [6, 111], [6, 127], [6, 143], [8, 15], [8, 31], [8, 47], [8, 63], [8, 79], [8, 95], [8, 111], [8, 127], [8, 143], [10, 15], [10, 31], [10, 47], [10, 63], [10, 79], [10, 95], [10, 111], [10, 127], [10, 143], [12, 15], [12, 31], [12, 47], [12, 63], [12, 79], [12, 95], [12, 111], [12, 127], [12, 143], [14, 15], [14, 31], [14, 47], [14, 63], [14, 79], [14, 95], [14, 111], [14, 127], [14, 143], [16, 15], [16, 31], [16, 47], [16, 63], [16, 79], [16, 95], [16, 111], [16, 127], [16, 143], [18, 15], [18, 31], [18, 47], [18, 63], [18, 79], [18, 95], [18, 111], [18, 127], [18, 143], [20, 15], [20, 31], [20, 47], [20, 63], [20, 79], [20, 95], [20, 111], [20, 127], [20, 143], [22, 15], [22, 31], [22, 47], [22, 63], [22, 79], [22, 95], [22, 111], [22, 127], [22, 143], [24, 15], [24, 31], [24, 47], [24, 63], [24, 79], [24, 95], [24, 111], [24, 127], [24, 143], [26, 15], [26, 31], [26, 47], [26, 63], [26, 79], [26, 95], [26, 111], [26, 127], [26, 143], [28, 15], [28, 31], [28, 47], [28, 63], [28, 79], [28, 95], [28, 111], [28, 127], [28, 143], [30, 15], [30, 31], [30, 47], [30, 63], [30, 79], [30, 95], [30, 111], [30, 127], [30, 143], [32, 15], [32, 31], [32, 47], [32, 63], [32, 79], [32, 95], [32, 111], [32, 127], [32, 143], [34, 15], [34, 31], [34, 47], [34, 63], [34, 79], [34, 95], [34, 111], [34, 127], [34, 143], [36, 15], [36, 31], [36, 47], [36, 63], [36, 79], [36, 95], [36, 111], [36, 127], [36, 143], [38, 15], [38, 31], [38, 47], [38, 63], [38, 79], [38, 95], [38, 111], [38, 127], [38, 143], [40, 15], [40, 31], [40, 47], [40, 63], [40, 79], [40, 95], [40, 111], [40, 127], [40, 143], [42, 15], [42, 31], [42, 47], [42, 63], [42, 79], [42, 95], [42, 111], [42, 127], [42, 143], [44, 15], [44, 31], [44, 47], [44, 63], [44, 79], [44, 95], [44, 111], [44, 127], [44, 143], [46, 15], [46, 31], [46, 47], [46, 63], [46, 79], [46, 95], [46, 111], [46, 127], [46, 143], [48, 15], [48, 31], [48, 47], [48, 63], [48, 79], [48, 95], [48, 111], [48, 127], [48, 143], [50, 15], [50, 31], [50, 47], [50, 63], [50, 79], [50, 95], [50, 111], [50, 127], [50, 143], [52, 15], [52, 31], [52, 47], [52, 63], [52, 79], [52, 95], [52, 111], [52, 127], [52, 143], [54, 31], [54, 63], [54, 95], [54, 127], [54, 143], [55, 0], [56, 31], [56, 63], [56, 95], [56, 127], [56, 143], [57, 0], [58, 31], [58, 63], [58, 95], [58, 127], [58, 143], [59, 0]

The oligonucleotide sequences used to produce 6H×10H×128B-M nucleic acid structures of the invention are designated SEQ ID NOs. 2352-2810, and the corresponding 5' end coordinates are shown respectively in Table 8. (See also Appendix, Table 6 of U.S. provisional application No. 61/675,309, filed Jul. 24, 2012, incorporated by reference herein.)

TABLE 8

[1, 23], [1, 39], [1, 55], [1, 71], [1, 87], [1, 103], [1, 119], [1, 135], [3, 23], [3, 39], [3, 55], [3, 71], [3, 87], [3, 103], [3, 119], [3, 135], [5, 39], [5, 71], [5, 103], [5, 135], [6, 8], [7, 23], [7, 39], [7, 55], [7, 71], [7, 87], [7, 103], [7, 119], [7, 135], [9, 23], [9, 39], [9, 55], [9, 71], [9, 87], [9, 103], [9, 119], [9, 135], [11, 23], [11, 55], [11, 87], [11, 119], [11, 135], [13, 23], [13, 39], [13, 55], [13, 71], [13, 87], [13, 103], [13, 119], [13, 135], [15, 23], [15, 39], [15, 55], [15, 71], [15, 87], [15, 103], [15, 119], [15, 135], [17, 39], [17, 71], [17, 103], [17, 135], [18, 8], [19, 23], [19, 39], [19, 55], [19, 71], [19, 87], [19, 103], [19, 119], [19, 135], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 23], [27, 39], [27, 55], [27, 71], [27, 87], [27, 103], [27, 119], [27, 135], [29, 39], [29, 71], [29, 103], [29, 135], [30, 8], [31, 23], [31, 39], [31, 55], [31, 71], [31, 87], [31, 103], [31, 119], [31, 135], [33, 23], [33, 39], [33, 55], [33, 71], [33, 87], [33, 103], [33, 119], [33, 135], [35, 23], [35, 55], [35, 87], [35, 119], [35, 135], [37, 23], [37, 39], [37, 55], [37, 71], [37, 87], [37, 103], [37, 119], [37, 135], [39, 23], [39, 39], [39, 55], [39, 71], [39, 87], [39, 103], [39, 119], [39, 135], [41, 39], [41, 71], [41, 103], [41, 135], [42, 8], [43, 23], [43, 39], [43, 55], [43, 71], [43, 87], [43, 103], [43, 119], [43, 135], [45, 23], [45, 39], [45, 55], [45, 71], [45, 87], [45, 103], [45, 119], [45, 135], [47, 23], [47, 55], [47, 87], [47, 119], [47, 135], [49, 23], [49, 39], [49, 55], [49, 71], [49, 87], [49, 103], [49, 119], [49, 135], [51, 23], [51, 39], [51, 55], [51, 71], [51, 87], [51, 103], [51, 119], [51, 135], [53, 39], [53, 71], [53, 103], [53, 135], [54, 8], [55, 23], [55, 39], [55, 55], [55, 71], [55, 87], [55, 103], [55, 119], [55, 135], [57, 23], [57, 39], [57, 55], [57, 71], [57, 87], [57, 103], [57, 119], [57, 135], [59, 23], [59, 55], [59, 87], [59, 119], [59, 135], [0, 47], [0, 79], [0, 111], [0, 143], [1, 0], [2, 47], [2, 79], [2, 111], [2, 143], [3, 0], [4, 47], [4, 79], [4, 111], [4, 143], [5, 0], [6, 31], [6, 47], [6, 63], [6, 79], [6, 95], [6, 111], [6, 127], [6, 143], [7, 0], [8, 31], [8, 47], [8, 63], [8, 79], [8, 95], [8, 111], [8, 127], [8, 143], [9, 0], [10, 31], [10, 47], [10, 63], [10, 79], [10, 95], [10, 111], [10, 127], [10, 143], [11, 0], [12, 31], [12, 47], [12, 63], [12, 79], [12, 95], [12, 111], [12, 127], [12, 143], [13, 0], [14, 31], [14, 47], [14, 63], [14, 79], [14, 95], [14, 111], [14, 127], [14, 143], [15, 0], [16, 31], [16, 47], [16, 63], [16, 79], [16, 95], [16, 111], [16, 127], [16, 143], [17, 0], [18, 31], [18, 47], [18, 63], [18, 79], [18, 95], [18, 111], [18, 127], [18, 143], [19, 0], [20, 31], [20, 47], [20, 63], [20, 79], [20, 95], [20, 111], [20, 127], [20, 143], [21, 0], [22, 31], [22, 47], [22, 63], [22, 79], [22, 95], [22, 111], [22, 127], [22, 143], [23, 0], [24, 31], [24, 47], [24, 63], [24, 79], [24, 95], [24, 111], [24, 127], [24, 143], [25, 0], [26, 31], [26, 47], [26, 63], [26, 79], [26, 95], [26, 111], [26, 127], [26, 143], [27, 0], [28, 31], [28, 47], [28, 63], [28, 79], [28, 95], [28, 111], [28, 127], [28, 143], [29, 0], [30, 31], [30, 47], [30, 63], [30, 79], [30, 95], [30, 111], [30, 127], [30, 143], [31, 0], [32, 31], [32, 47], [32, 63], [32, 79], [32, 95], [32, 111], [32, 127], [32, 143], [33, 0], [34, 31], [34, 47], [34, 63], [34, 79], [34, 95], [34, 111], [34, 127], [34, 143], [35, 0], [36, 31], [36, 47], [36, 63], [36, 79], [36, 95], [36, 111], [36, 127], [36, 143], [37, 0], [38, 31], [38, 47], [38, 63], [38, 79], [38, 95], [38, 111], [38, 127], [38, 143], [39, 0], [40, 31], [40, 47], [40, 63], [40, 79], [40, 95], [40, 111], [40, 127], [40, 143], [41, 0], [42, 31], [42, 47], [42, 63], [42, 79], [42, 95], [42, 111], [42, 127], [42, 143], [43, 0], [44, 31], [44, 47], [44, 63], [44, 79], [44, 95], [44, 111], [44, 127], [44, 143], [45, 0], [46, 31], [46, 47], [46, 63], [46, 79], [46, 95], [46, 111], [46, 127], [46, 143], [47, 0], [48, 31], [48, 47], [48, 63], [48, 79], [48, 95], [48, 111], [48, 127], [48, 143], [49, 0], [50, 31], [50, 47], [50, 63], [50, 79], [50, 95], [50, 111], [50, 127], [50, 143], [51, 0], [52, 31], [52, 47], [52, 63], [52, 79], [52, 95], [52, 111], [52, 127], [52, 143], [53, 0], [54, 31], [54, 63], [54, 95], [54, 127], [54, 143], [55, 0], [56, 31], [56, 63], [56, 95], [56, 127], [56, 143], [57, 0], [58, 31], [58, 63], [58, 95], [58, 127], [58, 143], [59, 0]

The core oligonucleotide sequences used to produce 3H×3H×32B nucleic acid structures of the invention are designated SEQ ID NOs. 2811-2822, and the corresponding voxel coordinates are shown respectively in Table 9A. The end oligonucleotide sequences used to produce 3H×3H×32B nucleic acid structures of the invention are designated SEQ ID NOs. 3195-3203, and the corresponding voxel coordinates are shown respectively in Table 9B. (See also Appendix, Table 7 of U.S. provisional application No. 61/675,309, filed Jul. 24, 2012, incorporated by reference herein.)

TABLE 9A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 3, 1], [3, 3, 3, 4, 3, 1, 3, 2, 4, 1, 4, 2].

TABLE 9B

[4, 2, 4, 3, 7, 2, 7, 3, 7, 4, 0, 0], [1, 3, 1, 4, 2, 3, 2, 4], [5, 3, 5, 4, 4, 3, 4, 4], [7, 3, 7, 4, 8, 3, 8, 4], [4, 4, 0, 0, 1, 4, 0, 0], [6, 4, 0, 0, 5, 4, 0, 0], [8, 4, 0, 0, 3, 4, 0, 0], [0, 4, 0, 0, 0, 2, 0, 3, 5, 2, 5, 3], [2, 4, 0, 0, 2, 2, 2, 3, 3, 2, 3, 3]

The core oligonucleotide sequences used to produce 3H×3H×64B nucleic acid structures of the invention are designated SEQ ID NOs. 2811-2834, and the corresponding voxel coordinates are shown respectively in Table 10A. The end oligonucleotide sequences used to produce 3H×3H×64B nucleic acid structures of the invention are designated SEQ ID NOs. 3203-3212, and the corresponding voxel coordinates are shown respectively in Table 10B. (See also Appendix, Table 7 of U.S. provisional application No. 61/675,309, filed Jul. 24, 2012, incorporated by reference herein.)

TABLE 10A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 3, 1], [3, 3, 3, 4, 3, 1, 3, 2, 4, 1, 4, 2], [4, 2, 4, 3, 7, 2, 7, 3, 7, 4, 7, 5], [1, 3, 1, 4, 2, 3, 2, 4, 2, 5, 2, 6], [7, 3, 7, 4, 8, 3, 8, 4, 8, 5, 8, 6], [0, 4, 0, 5, 0, 2, 0, 3, 5, 2, 5, 3], [4, 4, 4, 5, 1, 4, 1, 5, 1, 6, 1, 7], [2, 4, 2, 5, 2, 2, 2, 3, 3, 2, 3, 3], [1, 5, 1, 6, 0, 5, 0, 6, 0, 7, 0, 8], [5, 5, 5, 6, 5, 3, 5, 4, 4, 3, 4, 4], [7, 5, 7, 6, 6, 5, 6, 6, 6, 7, 6, 8], [6, 6, 6, 7, 6, 4, 6, 5, 5, 4, 5, 5], [8, 6, 8, 7, 8, 4, 8, 5, 3, 4, 3, 5][3, 7, 3, 8, 3, 5, 3, 6, 4, 5, 4, 6]

TABLE 10B

[2, 4, 0, 0, 2, 2, 2, 3, 3, 2, 3, 3], [4, 6, 4, 7, 7, 6, 7, 7, 7, 8, 0, 0], [1, 7, 1, 8, 2, 7, 2, 8], [5, 7, 5, 8, 4, 7, 4, 8], [7, 7, 7, 8, 8, 7, 8, 8], [4, 8, 0, 0, 1, 8, 0, 0], [6, 8, 0, 0, 5, 8, 0, 0], [8, 8, 0, 0, 3, 8, 0, 0], [0, 8, 0, 0, 6, 0, 7, 5, 6, 5, 7], [2, 8, 0, 0, 2, 6, 2, 7, 3, 6, 3, 7]

The core oligonucleotide sequences used to produce 3H×3H×128B nucleic acid structures of the invention are designated SEQ ID NOs. 2811-2858, and the corresponding voxel coordinates are shown respectively in Table 11A. The end oligonucleotide sequences used to produce 3H×3H×128B nucleic acid structures of the invention are designated SEQ ID NOs. 3213-3221, and the corresponding voxel coordinates are shown respectively in Table 11B. (See also Appendix, Table 7 of U.S. provisional application No. 61/675,309, filed Jul. 24, 2012, incorporated by reference herein.)

TABLE 11A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 3, 1], [3, 3, 3, 4, 3, 1, 3, 2, 4, 1, 4, 2], [4, 2, 4, 3, 7, 2, 7, 3, 7, 4, 7, 5], [1, 3, 1, 4, 2, 3, 2, 4, 2, 5, 2, 6], [7, 3, 7, 4, 8, 3, 8, 4, 8, 5, 8, 6], [0, 4, 0, 5, 0, 2, 0, 3, 5, 2, 5, 3], [4, 4, 4, 5, 1, 4, 1, 5, 1, 6, 1, 7], [2, 4, 2, 5, 2, 2, 2, 3, 3, 2, 3, 3], [1, 5, 1, 6, 0, 5, 0, 6, 0, 7, 0, 8], [5, 5, 5, 6, 5, 3, 5, 4, 4, 3, 4, 4], [7, 5, 7, 6, 6, 5, 6, 6, 6, 7, 6, 8], [6, 6, 6, 7, 6, 4, 6, 5, 5, 4, 5, 5], [8, 6, 8, 7, 8, 4, 8, 5, 3, 4, 3, 5], [3, 7, 3, 8, 3, 5, 3, 6, 4, 5, 4, 6], [4, 6, 4, 7, 7, 6, 7, 7, 7, 8, 7, 9], [1, 7, 1, 8, 2, 7, 2, 8, 2, 9, 2, 10], [7, 7, 7, 8, 8, 7, 8, 8, 8, 9, 8, 10], [0, 8, 0, 9, 0, 6, 0, 7, 5, 6, 5, 7], [4, 8, 4, 9, 1, 8, 1, 9, 1, 10, 1, 11], [2, 8, 2, 9, 2, 6, 2, 7, 3, 6, 3, 7], [1, 9, 1, 10, 0, 9, 0, 10, 0, 11, 0, 12], [5, 9, 5, 10, 5, 7, 5, 8, 4, 7, 4, 8], [7, 9, 7, 10, 6, 9, 6, 10, 6, 11, 6, 12], [6, 10, 6, 11, 6, 8, 6, 9, 5, 8, 5, 9], [4, 10, 4, 11, 7, 10, 7, 11, 7, 12, 7, 13], [8, 10, 8, 11, 8, 8, 8, 9, 3, 8, 3, 9], [1, 11, 1, 12, 2, 11, 2, 12, 2, 13, 2, 14], [3, 11, 3, 12, 3, 9, 3, 10, 4, 9, 4, 10], [7, 11, 7, 12, 8, 11, 8, 12, 8, 13, 8, 14], [0, 12, 0, 13, 0, 10, 0, 11, 5, 10, 5, 11], [4, 12, 4, 13, 1, 12, 1, 13, 1, 14, 1, 15], [2, 12, 2, 13, 2, 10, 2, 11, 3, 10, 3, 11], [1, 13, 1, 14, 0, 13, 0, 14, 0, 15, 0, 16], [5, 13, 5, 14, 5, 11, 5, 12, 4, 11, 4, 12], [7, 13, 7, 14, 6, 13, 6, 14, 6, 15, 6, 16], [6, 14, 6, 15, 6, 12, 6, 13, 5, 12, 5, 13], [8, 14, 8, 15, 8, 12, 8, 13, 3, 12, 3, 13], [3, 15, 3, 16, 3, 13, 3, 14, 4, 13, 4, 14]

TABLE 11B

[4, 14, 4, 15, 7, 14, 7, 15, 7, 16, 0, 0], [1, 15, 1, 16, 2, 15, 2, 16], [5, 15, 5, 16, 4, 15, 4, 16], [7, 15, 7, 16, 8, 15, 8, 16], [4, 16, 0, 0, 1, 16, 0, 0], [6, 16, 0, 0, 5, 16, 0, 0], [8, 16, 0, 0, 3, 16, 0, 0], [0, 16, 0, 0, 0, 14, 0, 15, 5, 14, 5, 15] and [2, 16, 0, 0, 2, 14, 2, 15, 3, 14, 3, 15]

The core oligonucleotide sequences used to produce 3H×3H×256B nucleic acid structures of the invention are designated SEQ ID NOs. 2811-2906 and the corresponding voxel coordinates are shown respectively in Table 12A. The end oligonucleotide sequences used to produce 3H×3H×256B nucleic acid structures of the invention are designated SEQ ID NOs. 3222-3230, and the corresponding voxel coordinates are shown respectively in Table 12B. (See also Appendix, Table 7 of U.S. provisional application No. 61/675,309, filed Jul. 24, 2012, incorporated by reference herein.)

TABLE 12A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 3, 1], [3, 3, 3, 4, 3, 1, 3, 2, 4, 1, 4, 2], [4, 2, 4, 3, 7, 2, 7, 3, 7, 4, 7, 5], [1, 3, 1, 4, 2, 3, 2, 4, 2, 5, 2, 6], [7, 3, 7, 4, 8, 3, 8,

TABLE 12A-continued 4, 8, 5, 8, 6], [0, 4, 0, 5, 0, 2, 0, 3, 5, 2, 5, 3], [4, 4, 4, 5, 1, 4, 1, 5, 1, 6, 1, 7], [2, 4, 2, 5, 2, 2, 2, 3, 3, 2, 3, 3], [1, 5, 1, 6, 0, 5, 0, 6, 0, 7, 0, 8], [5, 5, 5, 6, 5, 3, 5, 4, 4, 3, 4, 4], [7, 5, 7, 6, 6, 5, 6, 6, 6, 7, 6, 8], [6, 6, 6, 7, 6, 4, 6, 5, 5, 4, 5, 5], [8, 6, 8, 7, 8, 4, 8, 5, 3, 4, 3, 5], [3, 7, 3, 8, 3, 5, 3, 6, 4, 5, 4, 6], [4, 6, 4, 7, 7, 6, 7, 7, 7, 8, 7, 9], [1, 7, 1, 8, 2, 7, 2, 8, 2, 9, 2, 10], [7, 7, 7, 8, 8, 7, 8, 8, 8, 9, 8, 10], [0, 8, 0, 9, 0, 6, 0, 7, 5, 6, 5, 7], [4, 8, 4, 9, 1, 8, 1, 9, 1, 10, 1, 11], [2, 8, 2, 9, 2, 6, 2, 7, 3, 6, 3, 7], [1, 9, 1, 10, 0, 9, 0, 10, 0, 11, 0, 12], [5, 9, 5, 10, 5, 7, 5, 8, 4, 7, 4, 8], [7, 9, 7, 10, 6, 9, 6, 10, 6, 11, 6, 12], [6, 10, 6, 11, 6, 8, 6, 9, 5, 8, 5, 9], [4, 10, 4, 11, 7, 10, 7, 11, 7, 12, 7, 13], [8, 10, 8, 11, 8, 8, 8, 9, 3, 8, 3, 9], [1, 11, 1, 12, 2, 11, 2, 12, 2, 13, 2, 14], [3, 11, 3, 12, 3, 9, 3, 10, 4, 9, 4, 10], [7, 11, 7, 12, 8, 11, 8, 12, 8, 13, 8, 14], [0, 12, 0, 13, 0, 10, 0, 11, 5, 10, 5, 11], [4, 12, 4, 13, 1, 12, 1, 13, 1, 14, 1, 15], [2, 12, 2, 13, 2, 10, 2, 11, 3, 10, 3, 11], [1, 13, 1, 14, 0, 13, 0, 14, 0, 15, 0, 16], [5, 13, 5, 14, 5, 11, 5, 12, 4, 11, 4, 12], [7, 13, 7, 14, 6, 13, 6, 14, 6, 15, 6, 16], [6, 14, 6, 15, 6, 12, 6, 13, 5, 12, 5, 13], [8, 14, 8, 15, 8, 12, 8, 13, 3, 12, 3, 13], [3, 15, 3, 16, 3, 13, 3, 14, 4, 13, 4, 14], [4, 14, 4, 15, 7, 14, 7, 15, 7, 16, 7, 17], [1, 15, 1, 16, 2, 15, 2, 16, 2, 17, 2, 18], [7, 15, 7, 16, 8, 15, 8, 16, 8, 17, 8, 18], [0, 16, 0, 17, 0, 14, 0, 15, 5, 14, 5, 15], [4, 16, 4, 17, 1, 16, 1, 17, 1, 18, 1, 19], [2, 16, 2, 17, 2, 14, 2, 15, 3, 14, 3, 15], [1, 17, 1, 18, 0, 17, 0, 18, 0, 19, 0, 20], [5, 17, 5, 18, 5, 15, 5, 16, 4, 15, 4, 16], [7, 17, 7, 18, 6, 17, 6, 18, 6, 19, 6, 20], [6, 18, 6, 19, 6, 16, 6, 17, 5, 16, 5, 17], [4, 18, 4, 19, 7, 18, 7, 19, 7, 20, 7, 21], [8, 18, 8, 19, 8, 16, 8, 17, 3, 16, 3, 17], [1, 19, 1, 20, 2, 19, 2, 20, 2, 21, 2, 22], [3, 19, 3, 20, 3, 17, 3, 18, 4, 17, 4, 18], [7, 19, 7, 20, 8, 19, 8, 20, 8, 21, 8, 22], [0, 20, 0, 21, 0, 18, 0, 19, 5, 18, 5, 19], [4, 20, 4, 21, 1, 20, 1, 21, 1, 22, 1, 23], [2, 20, 2, 21, 2, 18, 2, 19, 3, 18, 3, 19], [1, 21, 1, 22, 0, 21, 0, 22, 0, 23, 0, 24], [5, 21, 5, 22, 5, 19, 5, 20, 4, 19, 4, 20], [7, 21, 7, 22, 6, 21, 6, 22, 6, 23, 6, 24], [6, 22, 6, 23, 6, 20, 6, 21, 5, 20, 5, 21], [4, 22, 4, 23, 7, 22, 7, 23, 7, 24, 7, 25], [8, 22, 8, 23, 8, 20, 8, 21, 3, 20, 3, 21], [1, 23, 1, 24, 2, 23, 2, 24, 2, 25, 2, 26], [3, 23, 3, 24, 3, 21, 3, 22, 4, 21, 4, 22], [7, 23, 7, 24, 8, 23, 8, 24, 8, 25, 8, 26], [0, 24, 0, 25, 0, 22, 0, 23, 5, 22, 5, 23], [4, 24, 4, 25, 1, 24, 1, 25, 1, 26, 1, 27], [2, 24, 2, 25, 2, 22, 2, 23, 3, 22, 3, 23], [1, 25, 1, 26, 0, 25, 0, 26, 0, 27, 0, 28], [5, 25, 5, 26, 5, 23, 5, 24, 4, 23, 4, 24], [7, 25, 7, 26, 6, 25, 6, 26, 6, 27, 6, 28], [6, 26, 6, 27, 6, 24, 6, 25, 5, 24, 5, 25], [4, 26, 4, 27, 7, 26, 7, 27, 7, 28, 7, 29], [8, 26, 8, 27, 8, 24, 8, 25, 3, 24, 3, 25], [1, 27, 1, 28, 2, 27, 2, 28, 2, 29, 2, 30], [3, 27, 3, 28, 3, 25, 3, 26, 4, 25, 4, 26], [7, 27, 7, 28, 8, 27, 8, 28, 8, 29, 8, 30], [0, 28, 0, 29, 0, 26, 0, 27, 5, 26, 5, 27], [4, 28, 4, 29, 1, 28, 1, 29, 1, 30, 1, 31], [2, 28, 2, 29, 2, 26, 2, 27, 3, 26, 3, 27], [1, 29, 1, 30, 0, 29, 0, 30, 0, 31, 0, 32], [5, 29, 5, 30, 5, 27, 5, 28, 4, 27, 4, 28], [7, 29, 7, 30, 6, 29, 6, 30, 6, 31, 6, 32], [6, 30, 6, 31, 6, 28, 6, 29, 5, 28, 5, 29], [8, 30, 8, 31, 8, 28, 8, 29, 3, 28, 3, 29], [3, 31, 3, 32, 3, 29, 3, 30, 4, 29, 4, 30]

TABLE 12B

[4, 30, 4, 31, 7, 30, 7, 31, 7, 32, 0, 0], [1, 31, 1, 32, 2, 31, 2, 32], [5, 31, 5, 32, 4, 31, 4, 32], [7, 31, 7, 32, 8, 31, 8, 32], [4, 32, 0, 0, 1, 32, 0, 0], [6, 32, 0, 0, 5, 32, 0, 0], [8, 32, 0, 0, 3, 32, 0, 0], [0, 32, 0, 0, 0, 30, 0, 31, 5, 30, 5, 31], [2, 32, 0, 0, 2, 30, 2, 31, 3, 30, 3, 31],

The core oligonucleotide sequences used to produce 3H×3H×512B nucleic acid structures of the invention are designated SEQ ID NOs. 2811-3002, and the corresponding voxel coordinates are shown respectively in Table 13A. The end oligonucleotide sequences used to produce 3H×3H×512B nucleic acid structures of the invention are designated SEQ ID NOs. 3231-3239, and the corresponding voxel coordinates are shown respectively in Table 13B. (See also Appendix, Table 7 of U.S. provisional application No. 61/675,309, filed Jul. 24, 2012, incorporated by reference herein.)

TABLE 13A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 3, 1], [3, 3, 3, 4, 3, 1, 3, 2, 4, 1, 4, 2], [4, 2, 4, 3, 7, 2, 7, 3, 7, 4, 7, 5], [1, 3, 1, 4, 2, 3, 2, 4, 2, 5, 2, 6], [7, 3, 7, 4, 8, 3, 8, 4, 8, 5, 8, 6], [0, 4, 0, 5, 0, 2, 0, 3, 5, 2, 5, 3], [4, 4, 4, 5, 1, 4, 1, 5, 1, 6, 1, 7], [2, 4, 2, 5, 2, 2, 2, 3, 3, 2, 3, 3], [1, 5, 1, 6, 0, 5, 0, 6, 0, 7, 0, 8], [5, 5, 5, 6, 5, 3, 5, 4, 4, 3, 4, 4], [7, 5, 7, 6, 6, 5, 6, 6, 6, 7, 6, 8], [6, 6, 6, 7, 6, 4, 6, 5, 5, 4, 5, 5], [8, 6, 8, 7, 8, 4, 8, 5, 3, 4, 3, 5], [3, 7, 3, 8, 3, 5, 3, 6, 4, 5, 4, 6], [4, 6, 4, 7, 7, 6, 7, 7, 7, 8, 7, 9], [1, 7, 1, 8, 2, 7, 2, 8, 2, 9, 2, 10], [7, 7, 7, 8, 8, 7, 8, 8, 8, 9, 8, 10], [0, 8, 0, 9, 0, 6, 0, 7, 5, 6, 5, 7], [4, 8, 4, 9, 1, 8, 1, 9, 1, 10, 1, 11], [2, 8, 2, 9, 2, 6, 2, 7, 3, 6, 3, 7], [1, 9, 1, 10, 0, 9, 0, 10, 0, 11, 0, 12], [5, 9, 5, 10, 5, 7, 5, 8, 4, 7, 4, 8], [7, 9, 7, 10, 6, 9, 6, 10, 6, 11, 6, 12], [6, 10, 6, 11, 6, 8, 6, 9, 5, 8, 5, 9], [4, 10, 4, 11, 7, 10, 7, 11, 7, 12, 7, 13], [8, 10, 8, 11, 8, 8, 8, 9, 3, 8, 3, 9], [1, 11, 1, 12, 2, 11, 2, 12, 2, 13, 2, 14], [3, 11, 3, 12, 3, 9, 3, 10, 4, 9, 4, 10], [7, 11, 7, 12, 8, 11, 8, 12, 8, 13, 8, 14], [0, 12, 0, 13, 0, 10, 0, 11, 5, 10, 5, 11], [4, 12, 4, 13, 1, 12, 1, 13, 1, 14, 1, 15], [2, 12, 2, 13, 2, 10, 2, 11, 3, 10, 3, 11], [1, 13, 1, 14, 0, 13, 0, 14, 0, 15, 0, 16], [5, 13, 5, 14, 5, 11, 5, 12, 4, 11, 4, 12], [7, 13, 7, 14, 6, 13, 6, 14, 6, 15, 6, 16], [6, 14, 6, 15, 6, 12, 6, 13, 5, 12, 5, 13], [8, 14, 8, 15, 8, 12, 8, 13, 3, 12, 3, 13], [3, 15, 3, 16, 3, 13, 3, 14, 4, 13, 4, 14], [4, 14, 4, 15, 7, 14, 7, 15, 7, 16, 7, 17], [1, 15, 1, 16, 2, 15, 2, 16, 2, 17, 2, 18], [7, 15, 7, 16, 8, 15, 8, 16, 8, 17, 8, 18], [0, 16, 0, 17, 0, 14, 0, 15, 5, 14, 5, 15], [4, 16, 4, 17, 1, 16, 1, 17, 1, 18, 1, 19], [2, 16, 2, 17, 2, 14, 2, 15, 3, 14, 3, 15], [1, 17, 1, 18, 0, 17, 0, 18, 0, 19, 0, 20], [5, 17, 5, 18, 5, 15, 5, 16, 4, 15, 4, 16], [7, 17, 7, 18, 6, 17, 6, 18, 6, 19, 6, 20], [6, 18, 6, 19, 6, 16, 6, 17, 5, 16, 5, 17], [4, 18, 4, 19, 7, 18, 7, 19, 7, 20, 7, 21], [8, 18, 8, 19, 8, 16, 8, 17, 3, 16, 3, 17], [1, 19, 1, 20, 2, 19, 2, 20, 2, 21, 2, 22], [3, 19, 3, 20, 3, 17, 3, 18, 4, 17, 4, 18], [7, 19, 7, 20, 8, 19, 8, 20, 8, 21, 8, 22], [0, 20, 0, 21, 0, 18, 0, 19, 5, 18, 5, 19], [4, 20, 4, 21, 1, 20, 1, 21, 1, 22, 1, 23], [2, 20, 2, 21, 2, 18, 2, 19, 3, 18, 3, 19], [1, 21, 1, 22, 0, 21, 0, 22, 0, 23, 0, 24], [5, 21, 5, 22, 5, 19, 5, 20, 4, 19, 4, 20], [7, 21, 7, 22, 6, 21, 6, 22, 6, 23, 6, 24], [6, 22, 6, 23, 6, 20, 6, 21, 5, 20, 5, 21], [4, 22, 4, 23, 7, 22, 7, 23, 7, 24, 7, 25], [8, 22, 8, 23, 8, 20, 8, 21, 3, 20, 3, 21], [1, 23, 1, 24, 2, 23, 2, 24, 2, 25, 2, 26], [3, 23, 3, 24, 3, 21, 3, 22, 4, 21, 4, 22], [7, 23, 7, 24, 8, 23, 8, 24, 8, 25, 8, 26], [0, 24, 0, 25, 0, 22, 0, 23, 5, 22, 5, 23], [4, 24, 4, 25, 1, 24, 1, 25, 1, 26, 1, 27], [2, 24, 2, 25, 2, 22, 2, 23, 3, 22, 3, 23], [1, 25, 1, 26, 0, 25, 0, 26, 0, 27, 0, 28], [5, 25, 5, 26, 5, 23, 5, 24, 4, 23, 4, 24], [7, 25, 7, 26, 6, 25, 6, 26, 6, 27, 6, 28], [6, 26, 6, 27, 6, 24, 6, 25, 5, 24, 5, 25], [4, 26, 4, 27, 7, 26, 7, 27, 7, 28, 7, 29], [8, 26, 8, 27, 8, 24, 8, 25, 3, 24, 3, 25], [1, 27, 1, 28, 2, 27, 2, 28, 2, 29, 2, 30], [3, 27, 3, 28, 3, 25, 3, 26, 4, 25, 4, 26], [7, 27, 7, 28, 8, 27, 8, 28, 8, 29, 8, 30], [0, 28, 0, 29, 0, 26, 0, 27, 5, 26, 5, 27], [4, 28, 4, 29, 1, 28, 1, 29, 1, 30, 1, 31], [2, 28, 2, 29, 2, 26, 2, 27, 3, 26, 3, 27], [1, 29, 1, 30, 0, 29, 0, 30, 0, 31, 0, 32], [5, 29, 5, 30, 5, 27, 5, 28, 4, 27, 4, 28], [7, 29, 7, 30, 6, 29, 6, 30, 6, 31, 6, 32], [6, 30, 6, 31, 6, 28, 6, 29, 5, 28, 5, 29], [8, 30, 8, 31, 8, 28, 8, 29, 3, 28, 3, 29], [3, 31, 3, 32, 3, 29, 3, 30, 4, 29, 4, 30], [4, 30, 4, 31, 7, 30, 7, 31, 7, 32, 7, 33], [1, 31, 1, 32, 2, 31, 2, 32, 2, 33, 2, 34], [7, 31, 7, 32, 8, 31, 8, 32, 8, 33, 8, 34], [0, 32, 0, 33, 0, 30, 0, 31, 5, 30, 5, 31], [4, 32, 4, 33, 1, 32, 1, 33, 1, 34, 1, 35], [2, 32, 2, 33, 2, 30, 2, 31, 3, 30, 3, 31], [1, 33, 1, 34, 0, 33, 0, 34, 0, 35, 0, 36], [5, 33, 5, 34, 5, 31, 5, 32, 4, 31, 4, 32], [7, 33, 7, 34, 6, 33, 6, 34, 6, 35, 6, 36], [6, 34, 6, 35, 6, 32, 6, 33, 5, 32, 5, 33], [4, 34, 4, 35, 7, 34, 7, 35, 7, 36, 7, 37], [8, 34, 8, 35, 8, 32, 8, 33, 3, 32, 3, 33], [1, 35, 1, 36, 2, 35, 2, 36, 2, 37, 2, 38], [3, 35, 3, 36, 3, 33, 3, 34, 4, 33, 4, 34], [7, 35, 7, 36, 8, 35, 8, 36, 8, 37, 8, 38], [0, 36, 0, 37, 0, 34, 0, 35, 5, 34, 5, 35], [4, 36, 4, 37, 1, 36, 1, 37, 1, 38, 1, 39], [2, 36, 2, 37, 2, 34, 2, 35, 3, 34, 3, 35], [1, 37, 1, 38, 0, 37, 0, 38, 0, 39, 0, 40], [5, 37, 5, 38, 5, 35, 5, 36, 4, 35, 4, 36], [7, 37, 7, 38, 6, 37, 6, 38, 6, 39, 6, 40], [6, 38, 6, 39, 6, 36, 6, 37, 5, 36, 5, 37], [4, 38, 4, 39, 7, 38, 7, 39, 7, 40, 7, 41], [8, 38, 8, 39, 8, 36, 8, 37, 3, 36, 3, 37], [1, 39, 1, 40, 2, 39, 2, 40, 2, 41, 2, 42], [3, 39, 3, 40, 3, 37, 3, 38, 4, 37, 4, 38], [7, 39, 7, 40, 8, 39, 8, 40, 8, 41, 8, 42], [0, 40, 0, 41, 0, 38, 0, 39, 5, 38, 5, 39], [4, 40, 4, 41, 1, 40, 1, 41, 1, 42, 1, 43], [2, 40, 2, 41, 2, 38, 2, 39, 3, 38, 3, 39], [1, 41, 1, 42, 0, 41, 0, 42, 0, 43, 0, 44], [5, 41, 5, 42, 5, 39, 5, 40, 4, 39, 4, 40], [7, 41, 7, 42, 6, 41, 6, 42, 6, 43, 6, 44], [6, 42, 6, 43, 6, 40, 6, 41, 5, 40, 5, 41], [4, 42, 4, 43, 7, 42, 7, 43, 7, 44, 7, 45], [8, 42, 8, 43, 8, 40, 8, 41, 3, 40, 3, 41], [1, 43, 1, 44, 2, 43, 2, 44, 2, 45, 2, 46], [3, 43, 3, 44, 3, 41, 3, 42, 4, 41, 4, 42], [7, 43, 7, 44, 8, 43, 8, 44, 8, 45, 8, 46], [0, 44, 0, 45, 0, 42, 0, 43, 5, 42, 5, 43], [4, 44, 4, 45, 1, 44, 1, 45, 1, 46, 1, 47], [2, 44, 2, 45, 2, 42, 2, 43, 3, 42, 3, 43], [1, 45, 1, 46, 0, 45, 0, 46, 0, 47, 0, 48], [5, 45, 5, 46, 5, 43, 5, 44, 4, 43, 4, 44], [7, 45, 7, 46, 6, 45, 6, 46, 6, 47, 6, 48], [6, 46, 6, 47, 6, 44, 6, 45, 5, 44, 5, 45], [4, 46, 4, 47, 7, 46, 7, 47, 7, 48, 7, 49], [8, 46, 8, 47, 8, 44, 8, 45, 3, 44, 3, 45], [1, 47, 1, 48, 2,

TABLE 13A-continued 47, 2, 48, 2, 49, 2, 50], [3, 47, 3, 48, 3, 45, 3, 46, 4, 45, 4, 46], [7, 47, 7, 48, 8, 47, 8, 48, 8, 49, 8, 50], [0, 48, 0, 49, 0, 46, 0, 47, 5, 46, 5, 47], [4, 48, 4, 49, 1, 48, 1, 49, 1, 50, 1, 51], [2, 48, 2, 49, 2, 46, 2, 47, 3, 46, 3, 47], [1, 49, 1, 50, 0, 49, 0, 50, 0, 51, 0, 52], [5, 49, 5, 50, 5, 47, 5, 48, 4, 47, 4, 48], [7, 49, 7, 50, 6, 49, 6, 50, 6, 51, 6, 52], [6, 50, 6, 51, 6, 48, 6, 49, 5, 48, 5, 49], [4, 50, 4, 51, 7, 50, 7, 51, 7, 52, 7, 53], [8, 50, 8, 51, 8, 48, 8, 49, 3, 48, 3, 49], [1, 51, 1, 52, 2, 51, 2, 52, 2, 53, 2, 54], [3, 51, 3, 52, 3, 49, 3, 50, 4, 49, 4, 50], [7, 51, 7, 52, 8, 51, 8, 52, 8, 53, 8, 54], [0, 52, 0, 53, 0, 50, 0, 51, 5, 50, 5, 51], [4, 52, 4, 53, 1, 52, 1, 53, 1, 54, 1, 55], [2, 52, 2, 53, 2, 50, 2, 51, 3, 50, 3, 51], [1, 53, 1, 54, 0, 53, 0, 54, 0, 55, 0, 56], [5, 53, 5, 54, 5, 51, 5, 52, 4, 51, 4, 52], [7, 53, 7, 54, 6, 53, 6, 54, 6, 55, 6, 56], [6, 54, 6, 55, 6, 52, 6, 53, 5, 52, 5, 53], [4, 54, 4, 55, 7, 54, 7, 55, 7, 56, 7, 57], [8, 54, 8, 55, 8, 52, 8, 53, 3, 52, 3, 53], [1, 55, 1, 56, 2, 55, 2, 56, 2, 57, 2, 58], [3, 55, 3, 56, 3, 53, 3, 54, 4, 53, 4, 54], [7, 55, 7, 56, 8, 55, 8, 56, 8, 57, 8, 58], [0, 56, 0, 57, 0, 54, 0, 55, 5, 54, 5, 55], [4, 56, 4, 57, 1, 56, 1, 57, 1, 58, 1, 59], [2, 56, 2, 57, 2, 54, 2, 55, 3, 54, 3, 55], [1, 57, 1, 58, 0, 57, 0, 58, 0, 59, 0, 60], [5, 57, 5, 58, 5, 55, 5, 56, 4, 55, 4, 56], [7, 57, 7, 58, 6, 57, 6, 58, 6, 59, 6, 60], [6, 58, 6, 59, 6, 56, 6, 57, 5, 56, 5, 57], [4, 58, 4, 59, 7, 58, 7, 59, 7, 60, 7, 61], [8, 58, 8, 59, 8, 56, 8, 57, 3, 56, 3, 57], [1, 59, 1, 60, 2, 59, 2, 60, 2, 61, 2, 62], [3, 59, 3, 60, 3, 57, 3, 58, 4, 57, 4, 58], [7, 59, 7, 60, 8, 59, 8, 60, 8, 61, 8, 62], [0, 60, 0, 61, 0, 58, 0, 59, 5, 58, 5, 59], [4, 60, 4, 61, 1, 60, 1, 61, 1, 62, 1, 63], [2, 60, 2, 61, 2, 58, 2, 59, 3, 58, 3, 59], [1, 61, 1, 62, 0, 61, 0, 62, 0, 63, 0, 64], [5, 61, 5, 62, 5, 59, 5, 60, 4, 59, 4, 60], [7, 61, 7, 62, 6, 61, 6, 62, 6, 63, 6, 64], [6, 62, 6, 63, 6, 60, 6, 61, 5, 60, 5, 61], [8, 62, 8, 63, 8, 60, 8, 61, 3, 60, 3, 61], [3, 63, 3, 64, 3, 61, 3, 62, 4, 61, 4, 62]

TABLE 13B

[4, 62, 4, 63, 7, 62, 7, 63, 7, 64, 0, 0], [1, 63, 1, 64, 4, 63, 4, 64], [7, 64, 2, 63, 2, 64], [5, 63, 5, 63, 7, 64, 8, 63, 8, 64], [4, 64, 0, 0, 1, 64, 0, 0], [6, 64, 0, 0, 5, 64, 0, 0], [8, 64, 0, 0, 3, 64, 0, 0], [0, 64, 0, 0, 0, 62, 0, 63, 5, 62, 5, 63], [2, 64, 0, 0, 2, 62, 2, 63, 3, 62, 3, 63]

The core oligonucleotide sequences used to produce 3H×3H×1024B nucleic acid structures of the invention are designated SEQ ID NOs. 2811-3194, and the corresponding voxel coordinates are shown respectively in Table 14A. The end oligonucleotide sequences used to produce 3H×3H×1024B nucleic acid structures of the invention are designated SEQ ID NOs. 3240-3248, and the corresponding voxel coordinates are shown respectively in Table 14B. (See also Appendix, Table 7 of U.S. provisional application No. 61/675,309, filed Jul. 24, 2012, incorporated by reference herein.)

TABLE 14A

[0, 0, 0, 1, 0, 0, 0, 0], [0, 0, 2, 1, 0, 0, 0, 0], [0, 0, 7, 1, 0, 0, 0, 0], [0, 0, 4, 1, 0, 0, 1, 1, 1, 2, 1, 3], [2, 1, 2, 2, 0, 0, 0, 0], [5, 1, 5, 2, 0, 0, 0, 0], [8, 1, 8, 2, 0, 0, 0, 0], [1, 1, 1, 2, 0, 1, 0, 2, 0, 3, 0, 4], [7, 1, 7, 2, 6, 1, 6, 2, 6, 3, 6, 4], [6, 2, 6, 3, 0, 0, 6, 1, 0, 0, 5, 1], [8, 2, 8, 3, 0, 0, 8, 1, 0, 0, 0, 3, 1], [3, 3, 3, 4, 3, 1, 3, 2, 4, 1, 4, 2], [4, 2, 4, 3, 7, 2, 7, 3, 7, 4, 7, 5], [1, 3, 1, 4, 2, 3, 2, 4, 2, 5, 2, 6], [7, 3, 7, 4, 8, 3, 8, 4, 8, 5, 8, 6], [0, 4, 0, 5, 0, 2, 0, 3, 5, 2, 5, 3], [4, 4, 4, 5, 1, 4, 1, 5, 1, 6, 1, 7], [2, 4, 2, 5, 2, 2, 2, 3, 3, 2, 3, 3], [1, 5, 1, 6, 0, 5, 0, 6, 0, 7, 0, 8], [5, 5, 5, 6, 5, 3, 5, 4, 4, 3, 4, 4], [7, 5, 7, 6, 6, 5, 6, 6, 6, 7, 6, 8], [6, 6, 6, 7, 6, 4, 6, 5, 5, 4, 5, 5], [8, 6, 8, 7, 8, 4, 8, 5, 3, 4, 3, 5], [3, 7, 3, 8, 3, 5, 3, 6, 4, 5, 4, 6], [4, 6, 4, 7, 7, 6, 7, 7, 7, 8, 7, 9], [1, 7, 1, 8, 2, 7, 2, 8, 2, 9, 2, 10], [7, 7, 7, 8, 8, 7, 8, 8, 8, 9, 8, 10], [0, 8, 0, 9, 0, 6, 0, 7, 5, 6, 5, 7], [4, 8, 4, 9, 1, 8, 1, 9, 1, 10, 1, 11], [2, 8, 2, 9, 2, 6, 2, 7, 3, 6, 3, 7], [1, 9, 1, 10, 0, 9, 0, 10, 0, 11, 0, 12], [5, 9, 5, 10, 5, 7, 5, 8, 4, 7, 4, 8], [7, 9, 7, 10, 6, 9, 6, 10, 6, 11, 6, 12], [6, 10, 6, 11, 6, 8, 6, 9, 5, 8, 5, 9], [4, 10, 4, 11, 7, 10, 7, 11, 7, 12, 7, 13], [8, 10, 8, 11, 8, 8, 8, 9, 3, 8, 3, 9], [1, 11, 1, 12, 2, 11, 2, 12, 2, 13, 2, 14], [3, 11, 3, 12, 3, 9, 3, 10, 4, 9, 4, 10], [7, 11, 7, 12, 8, 11, 8, 12, 8, 13, 8, 14], [0, 12, 0, 13, 0, 10, 0, 11, 5, 10, 5, 11], [4, 12, 4, 13, 1, 12, 1, 13, 1, 14, 1, 15], [2, 12, 2, 13, 2, 10, 2, 11, 3, 10, 3, 11], [1, 13, 1, 14, 0, 13, 0, 14, 0, 15, 0, 16], [5, 13, 5, 14, 5, 11, 5, 12, 4, 11, 4, 12], [7, 13, 7, 14, 6, 13, 6, 14, 6, 15, 6, 16], [6, 14, 6, 15, 6, 12, 6, 13, 5, 12, 5, 13], [8, 14, 8, 15, 8, 12, 8, 13, 3, 12, 3, 13], [3, 15, 3, 16, 3, 13, 3, 14, 4, 13, 4, 14], [4, 14, 4, 15, 7, 14, 7, 15, 7, 16, 7, 17], [1, 15, 1, 16, 2, 15, 2, 16, 2, 17, 2, 18], [7, 15, 7, 16, 8, 15, 8, 16, 8, 17, 8, 18], [0, 16, 0, 17, 0, 14, 0, 15, 5, 14, 5, 15], [4, 16, 4, 17, 1, 16, 1, 17, 1, 18, 1, 19], [2, 16, 2, 17, 2, 14, 2, 15, 3, 14, 3, 15], [1, 17, 1, 18, 0, 17, 0, 18, 0, 19, 0, 20], [5, 17, 5, 18, 5, 15, 5, 16, 4, 15, 4, 16], [7, 17, 7, 18, 6, 17, 6, 18, 6, 19, 6, 20], [6, 18, 6, 19, 6, 16, 6, 17, 5, 16, 5, 17], [4, 18, 4, 19, 7, 18, 7, 19, 7, 20, 7, 21], [8, 18, 8, 19, 8, 16, 8, 17, 3, 16, 3, 17], [1, 19, 1, 20, 2, 19, 2, 20, 2, 21, 2, 22], [3, 19, 3, 20, 3, 17, 3, 18, 4, 17, 4, 18], [7, 19, 7, 20, 8, 19, 8, 20, 8, 21, 8, 22], [0, 20, 0, 21, 0, 18, 0, 19, 5, 18, 5, 19], [4, 20, 4, 21, 1, 20, 1, 21, 1, 22, 1, 23], [2, 20, 2, 21, 2, 18, 2, 19, 3, 18, 3, 19], [1, 21, 1, 22, 0, 21, 0, 22, 0, 23, 0, 24], [5, 21, 5, 22, 5, 19, 5, 20, 4, 19, 4, 20], [7, 21, 7, 22, 6, 21, 6, 22, 6, 23, 6, 24], [6, 22, 6, 23, 6, 20, 6, 21, 5, 20, 5, 21], [4, 22, 4, 23, 7, 22, 7, 23, 7, 24, 7, 25], [8, 22, 8, 23, 8, 20, 8, 21, 3, 20, 3, 21], [1, 23, 1, 24, 2, 23, 2, 24, 2, 25, 2, 26], [3, 23, 3, 24, 3, 21, 3, 22, 4, 21, 4, 22], [7, 23, 7, 24, 8, 23, 8, 24, 8, 25, 8, 26], [0, 24, 0, 25, 0, 22, 0, 23, 5, 22, 5, 23], [4, 24, 4, 25, 1, 24, 1, 25, 1, 26, 1, 27], [2, 24, 2, 25, 2, 22, 2, 23, 3, 22, 3, 23], [1, 25, 1, 26, 0, 25, 0, 26, 0, 27, 0, 28], [5, 25, 5, 26, 5, 23, 5, 24, 4, 23, 4, 24], [7, 25, 7, 26, 6, 25, 6, 26, 6, 27, 6, 28], [6, 26, 6, 27, 6, 24, 6, 25, 5, 24, 5, 25], [4, 26, 4, 27, 7, 26, 7, 27, 7, 28, 7, 29], [8, 26, 8, 27, 8, 24, 8, 25, 3, 24, 3, 25], [1, 27, 1, 28, 2, 27, 2, 28, 2, 29, 2, 30], [3, 27, 3, 28, 3, 25, 3, 26, 4, 25, 4, 26], [7, 27, 7, 28, 8, 27, 8, 28, 8, 29, 8, 30], [0, 28, 0, 29, 0, 26, 0, 27, 5, 26, 5, 27], [4, 28, 4, 29, 1, 28, 1, 29, 1, 30, 1, 31], [2, 28, 2, 29, 2, 26, 2, 27, 3, 26, 3, 27], [1, 29, 1, 30, 0, 29, 0, 30, 0, 31, 0, 32], [5, 29, 5, 30, 5, 27, 5, 28, 4, 27, 4, 28], [7, 29, 7, 30, 6, 29, 6, 30, 6, 31, 6, 32], [6, 30, 6, 31, 6, 28, 6, 29, 5, 28, 5, 29], [8, 30, 8, 31, 8, 28, 8, 29, 3, 28, 3, 29], [3, 31, 3, 32, 3, 29, 3, 30, 4, 29, 4, 30], [4, 30, 4, 31, 7, 30, 7, 31, 7, 32, 7, 33], [1, 31, 1, 32, 2, 31, 2, 32, 2, 33, 2, 34], [7, 31, 7, 32, 8, 31, 8, 32, 8, 33, 8, 34], [0, 32, 0, 33, 0, 30, 0, 31, 5, 30, 5, 31], [4, 32, 4, 33, 1, 32, 1, 33, 1, 34, 1, 35], [2, 32, 2, 33, 2, 30, 2, 31, 3, 30, 3, 31], [1, 33, 1, 34, 0, 33, 0, 34, 0, 35, 0, 36], [5, 33, 5, 34, 5, 31, 5, 32, 4, 31, 4, 32], [7, 33, 7, 34, 6, 33, 6, 34, 6, 35, 6, 36], [6, 34, 6, 35, 6, 32, 6, 33, 5, 32, 5, 33], [4, 34, 4, 35, 7, 34, 7, 35, 7, 36, 7, 37], [8, 34, 8, 35, 8, 32, 8, 33, 3, 32, 3, 33], [1, 35, 1, 36, 2, 35, 2, 36, 2, 37, 2, 38], [3, 35, 3, 36, 3, 33, 3, 34, 4, 33, 4, 34], [7, 35, 7, 36, 8, 35, 8, 36, 8, 37, 8, 38], [0, 36, 0, 37, 0, 34, 0, 35, 5, 34, 5, 35], [4, 36, 4, 37, 1, 36, 1, 37, 1, 38, 1, 39], [2, 36, 2, 37, 2, 34, 2, 35, 3, 34, 3, 35], [1, 37, 1, 38, 0, 37, 0, 38, 0, 39, 0, 40], [5, 37, 5, 38, 5, 35, 5, 36, 4, 35, 4, 36], [7, 37, 7, 38, 6, 37, 6, 38, 6, 39, 6, 40], [6, 38, 6, 39, 6, 36, 6, 37, 5, 36, 5, 37], [4, 38, 4, 39, 7, 38, 7, 39, 7, 40, 7, 41], [8, 38, 8, 39, 8, 36, 8, 37, 3, 36, 3, 37], [1, 39, 1, 40, 2, 39, 2, 40, 2, 41, 2, 42], [3, 39, 3, 40, 3, 37, 3, 38, 4, 37, 4, 38], [7, 39, 7, 40, 8, 39, 8, 40, 8, 41, 8, 42], [0, 40, 0, 41, 0, 38, 0, 39, 5, 38, 5, 39], [4, 40, 4, 41, 1, 40, 1, 41, 1, 42, 1, 43], [2, 40, 2, 41, 2, 38, 2, 39, 3, 38, 3, 39], [1, 41, 1, 42, 0, 41, 0, 42, 0, 43, 0, 44], [5, 41, 5, 42, 5, 39, 5, 40, 4, 39, 4, 40], [7, 41, 7, 42, 6, 41, 6, 42, 6, 43, 6, 44], [6, 42, 6, 43, 6, 40, 6, 41, 5, 40, 5, 41], [4, 42, 4, 43, 7, 42, 7, 43, 7, 44, 7, 45], [8, 42, 8, 43, 8, 40, 8, 41, 3, 40, 3, 41], [1, 43, 1, 44, 2, 43, 2, 44, 2, 45, 2, 46], [3, 43, 3, 44, 3, 41, 3, 42, 4, 41, 4, 42], [7, 43, 7, 44, 8, 43, 8, 44, 8, 45, 8, 46], [0, 44, 0, 45, 0, 42, 0, 43, 5, 42, 5, 43], [4, 44, 4, 45, 1, 44, 1, 45, 1, 46, 1, 47], [2, 44, 2, 45, 2, 42, 2, 43, 3, 42, 3, 43], [1, 45, 1, 46, 0, 45, 0, 46, 0, 47, 0, 48], [5, 45, 5, 46, 5, 43, 5, 44, 4, 43, 4, 44], [7, 45, 7, 46, 6, 45, 6, 46, 6, 47, 6, 48], [6, 46, 6, 47, 6, 44, 6, 45, 5, 44, 5, 45], [4, 46, 4, 47, 7, 46, 7, 47, 7, 48, 7, 49], [8, 46, 8, 47, 8, 44, 8, 45, 3, 44, 3, 45], [1, 47, 1, 48, 2, 47, 2, 48, 2, 49, 2, 50], [3, 47, 3, 48, 3, 45, 3, 46, 4, 45, 4, 46], [7, 47, 7, 48, 8, 47, 8, 48, 8, 49, 8, 50], [0, 48, 0, 49, 0, 46, 0, 47, 5, 46, 5, 47], [4, 48, 4, 49, 1, 48, 1, 49, 1, 50, 1, 51], [2, 48, 2, 49, 2, 46, 2, 47, 3, 46, 3, 47], [1, 49, 1, 50, 0, 49, 0, 50, 0, 51, 0, 52], [5, 49, 5, 50, 5, 47, 5, 48, 4, 47, 4, 48], [7, 49, 7, 50, 6, 49, 6, 50, 6, 51, 6, 52], [6, 50, 6, 51, 6, 48, 6, 49, 5, 48, 5, 49], [4, 50, 4, 51, 7, 50, 7, 51, 7, 52, 7, 53], [8, 50, 8, 51, 8, 48, 8, 49, 3, 48, 3, 49], [1, 51, 1, 52, 2, 51, 2, 52, 2, 53, 2, 54], [3, 51, 3, 52, 3, 49, 3, 50, 4, 49, 4, 50], [7, 51, 7, 52, 8, 51, 8, 52, 8, 53, 8, 54], [0, 52, 0, 53, 0, 50, 0, 51, 5, 50, 5, 51], [4, 52, 4, 53, 1, 52, 1, 53, 1, 54, 1, 55], [2, 52, 2, 53, 2, 50, 2, 51, 3, 50, 3, 51], [1, 53, 1, 54, 0, 53, 0, 54, 0, 55, 0, 56], [5, 53, 5, 54, 5, 51, 5, 52, 4, 51, 4, 52], [7, 53, 7, 54, 6, 53, 6, 54, 6, 55, 6, 56], [6, 54, 6, 55, 6, 52, 6, 53, 5, 52, 5, 53], [4, 54, 4, 55, 7, 54, 7, 55, 7, 56, 7, 57], [8, 54, 8, 55, 8, 52, 8, 53, 3, 52, 3, 53], [1, 55, 1, 56, 2, 55, 2, 56, 2, 57, 2, 58], [3, 55, 3, 56, 3, 53, 3, 54, 4, 53, 4, 54], [7, 55, 7, 56, 8, 55, 8, 56, 8, 57, 8, 58], [0, 56, 0, 57, 0, 54, 0, 55, 5, 54, 5, 55], [4, 56, 4, 57, 1, 56, 1, 57, 1, 58, 1, 59], [2, 56, 2, 57, 2, 54, 2, 55, 3, 54, 3, 55], [1, 57, 1, 58, 0, 57, 0, 58, 0, 59, 0, 60], [5, 57,

TABLE 14A-continued 5, 58, 5, 55, 5, 56, 4, 55, 4, 56], [7, 57, 7, 58, 6, 57, 6, 58, 6, 59, 6, 60], [6, 58, 6, 59, 6, 56, 6, 57, 5, 56, 5, 57], [4, 58, 4, 59, 7, 58, 7, 59, 7, 60, 7, 61], [8, 58, 8, 59, 8, 56, 8, 57, 3, 56, 3, 57], [1, 59, 1, 60, 2, 59, 2, 60, 2, 61, 2, 62], [3, 59, 3, 60, 3, 57, 3, 58, 4, 57, 4, 58], [7, 59, 7, 60, 8, 59, 8, 60, 8, 61, 8, 62], [0, 60, 0, 61, 0, 58, 0, 59, 5, 58, 5, 59], [4, 60, 4, 61, 1, 60, 1, 61, 1, 62, 1, 63], [2, 60, 2, 61, 2, 58, 2, 59, 3, 58, 3, 59], [1, 61, 1, 62, 0, 61, 0, 62, 0, 63, 0, 64], [5, 61, 5, 62, 5, 59, 5, 60, 4, 59, 4, 60], [7, 61, 7, 62, 6, 61, 6, 62, 6, 63, 6, 64], [6, 62, 6, 63, 6, 60, 6, 61, 5, 60, 5, 61], [8, 62, 8, 63, 8, 60, 8, 61, 3, 60, 3, 61], [3, 63, 3, 64, 3, 61, 3, 62, 4, 61, 4, 62], [4, 62, 4, 63, 7, 62, 7, 63, 7, 64, 7, 65], [1, 63, 1, 64, 2, 63, 2, 64, 2, 65, 2, 66], [7, 63, 7, 64, 8, 63, 8, 64, 8, 65, 8, 66], [0, 64, 0, 65, 0, 62, 0, 63, 5, 62, 5, 63], [4, 64, 4, 65, 1, 64, 1, 65, 1, 66, 1, 67], [2, 64, 2, 65, 2, 62, 2, 63, 3, 62, 3, 63], [1, 65, 1, 66, 0, 65, 0, 66, 0, 67, 0, 68], [5, 65, 5, 66, 5, 63, 5, 64, 4, 63, 4, 64], [7, 65, 7, 66, 6, 65, 6, 66, 6, 67, 6, 68], [6, 66, 6, 67, 6, 64, 6, 65, 5, 64, 5, 65], [4, 66, 4, 67, 7, 66, 7, 67, 7, 68, 7, 69], [8, 66, 8, 67, 8, 64, 8, 65, 3, 64, 3, 65], [1, 67, 1, 68, 2, 67, 2, 68, 2, 69, 2, 70], [3, 67, 3, 68, 3, 65, 3, 66, 4, 65, 4, 66], [7, 67, 7, 68, 8, 67, 8, 68, 8, 69, 8, 70], [0, 68, 0, 69, 0, 66, 0, 67, 5, 66, 5, 67], [4, 68, 4, 69, 1, 68, 1, 69, 1, 70, 1, 71], [2, 68, 2, 69, 2, 66, 2, 67, 3, 66, 3, 67], [1, 69, 1, 70, 0, 69, 0, 70, 0, 71, 0, 72], [5, 69, 5, 70, 5, 67, 5, 68, 4, 67, 4, 68], [7, 69, 7, 70, 6, 69, 6, 70, 6, 71, 6, 72], [6, 70, 6, 71, 6, 68, 6, 69, 5, 68, 5, 69], [4, 70, 4, 71, 7, 70, 7, 71, 7, 72, 7, 73], [8, 70, 8, 71, 8, 68, 8, 69, 3, 68, 3, 69], [1, 71, 1, 72, 2, 71, 2, 72, 2, 73, 2, 74], [3, 71, 3, 72, 3, 69, 3, 70, 4, 69, 4, 70], [7, 71, 7, 72, 8, 71, 8, 72, 8, 73, 8, 74], [0, 72, 0, 73, 0, 70, 0, 71, 5, 70, 5, 71], [4, 72, 4, 73, 1, 72, 1, 73, 1, 74, 1, 75], [2, 72, 2, 73, 2, 70, 2, 71, 3, 70, 3, 71], [1, 73, 1, 74, 0, 73, 0, 74, 0, 75, 0, 76], [5, 73, 5, 74, 5, 71, 5, 72, 4, 71, 4, 72], [7, 73, 7, 74, 6, 73, 6, 74, 6, 75, 6, 76], [6, 74, 6, 75, 6, 72, 6, 73, 5, 72, 5, 73], [4, 74, 4, 75, 7, 74, 7, 75, 7, 76, 7, 77], [8, 74, 8, 75, 8, 72, 8, 73, 3, 72, 3, 73], [1, 75, 1, 76, 2, 75, 2, 76, 2, 77, 2, 78], [3, 75, 3, 76, 3, 73, 3, 74, 4, 73, 4, 74], [7, 75, 7, 76, 8, 75, 8, 76, 8, 77, 8, 78], [0, 76, 0, 77, 0, 74, 0, 75, 5, 74, 5, 75], [4, 76, 4, 77, 1, 76, 1, 77, 1, 78, 1, 79], [2, 76, 2, 77, 2, 74, 2, 75, 3, 74, 3, 75], [1, 77, 1, 78, 0, 77, 0, 78, 0, 79, 0, 80], [5, 77, 5, 78, 5, 75, 5, 76, 4, 75, 4, 76], [7, 77, 7, 78, 6, 77, 6, 78, 6, 79, 6, 80], [6, 78, 6, 79, 6, 76, 6, 77, 5, 76, 5, 77], [4, 78, 4, 79, 7, 78, 7, 79, 7, 80, 7, 81], [8, 78, 8, 79, 8, 76, 8, 77, 3, 76, 3, 77], [1, 79, 1, 80, 2, 79, 2, 80, 2, 81, 2, 82], [3, 79, 3, 80, 3, 77, 3, 78, 4, 77, 4, 78], [7, 79, 7, 80, 8, 79, 8, 80, 8, 81, 8, 82], [0, 80, 0, 81, 0, 78, 0, 79, 5, 78, 5, 79], [4, 80, 4, 81, 1, 80, 1, 81, 1, 82, 1, 83], [2, 80, 2, 81, 2, 78, 2, 79, 3, 78, 3, 79], [1, 81, 1, 82, 0, 81, 0, 82, 0, 83, 0, 84], [5, 81, 5, 82, 5, 79, 5, 80, 4, 79, 4, 80], [7, 81, 7, 82, 6, 81, 6, 82, 6, 83, 6, 84], [6, 82, 6, 83, 6, 80, 6, 81, 5, 80, 5, 81], [4, 82, 4, 83, 7, 82, 7, 83, 7, 84, 7, 85], [8, 82, 8, 83, 8, 80, 8, 81, 3, 80, 3, 81], [1, 83, 1, 84, 2, 83, 2, 84, 2, 85, 2, 86], [3, 83, 3, 84, 3, 81, 3, 82, 4, 81, 4, 82], [7, 83, 7, 84, 8, 83, 8, 84, 8, 85, 8, 86], [0, 84, 0, 85, 0, 82, 0, 83, 5, 82, 5, 83], [4, 84, 4, 85, 1, 84, 1, 85, 1, 86, 1, 87], [2, 84, 2, 85, 2, 82, 2, 83, 3, 82, 3, 83], [1, 85, 1, 86, 0, 85, 0, 86, 0, 87, 0, 88], [5, 85, 5, 86, 5, 83, 5, 84, 4, 83, 4, 84], [7, 85, 7, 86, 6, 85, 6, 86, 6, 87, 6, 88], [6, 86, 6, 87, 6, 84, 6, 85, 5, 84, 5, 85], [4, 86, 4, 87, 7, 86, 7, 87, 7, 88, 7, 89], [8, 86, 8, 87, 8, 84, 8, 85, 3, 84, 3, 85], [1, 87, 1, 88, 2, 87, 2, 88, 2, 89, 2, 90], [3, 87, 3, 88, 3, 85, 3, 86, 4, 85, 4, 86], [7, 87, 7, 88, 8, 87, 8, 88, 8, 89, 8, 90], [0, 88, 0, 89, 0, 86, 0, 87, 5, 86, 5, 87], [4, 88, 4, 89, 1, 88, 1, 89, 1, 90, 1, 91], [2, 88, 2, 89, 2, 86, 2, 87, 3, 86, 3, 87], [1, 89, 1, 90, 0, 89, 0, 90, 0, 91, 0, 92], [5, 89, 5, 90, 5, 87, 5, 88, 4, 87, 4, 88], [7, 89, 7, 90, 6, 89, 6, 90, 6, 91, 6, 92], [6, 90, 6, 91, 6, 88, 6, 89, 5, 88, 5, 89], [4, 90, 4, 91, 7, 90, 7, 91, 7, 92, 7, 93], [8, 90, 8, 91, 8, 88, 8, 89, 3, 88, 3, 89], [1, 91, 1, 92, 2, 91, 2, 92, 2, 93, 2, 94], [3, 91, 3, 92, 3, 89, 3, 90, 4, 89, 4, 90], [7, 91, 7, 92, 8, 91, 8, 92, 8, 93, 8, 94], [0, 92, 0, 93, 0, 90, 0, 91, 5, 90, 5, 91], [4, 92, 4, 93, 1, 92, 1, 93, 1, 94, 1, 95], [2, 92, 2, 93, 2, 90, 2, 91, 3, 90, 3, 91], [1, 93, 1, 94, 0, 93, 0, 94, 0, 95, 0, 96], [5, 93, 5, 94, 5, 91, 5, 92, 4, 91, 4, 92], [7, 93, 7, 94, 6, 93, 6, 94, 6, 95, 6, 96], [6, 94, 6, 95, 6, 92, 6, 93, 5, 92, 5, 93], [4, 94, 4, 95, 7, 94, 7, 95, 7, 96, 7, 97], [8, 94, 8, 95, 8, 92, 8, 93, 3, 92, 3, 93], [1, 95, 1, 96, 2, 95, 2, 96, 2, 97, 2, 98], [3, 95, 3, 96, 3, 93, 3, 94, 4, 93, 4, 94], [7, 95, 7, 96, 8, 95, 8, 96, 8, 97, 8, 98], [0, 96, 0, 97, 0, 94, 0, 95, 5, 94, 5, 95], [4, 96, 4, 97, 1, 96, 1, 97, 1, 98, 1, 99], [2, 96, 2, 97, 2, 94, 2, 95, 3, 94, 3, 95], [1, 97, 1, 98, 0, 97, 0, 98, 0, 99, 0, 100], [5, 97, 5, 98, 5, 95, 5, 96, 4, 95, 4, 96], [7, 97, 7, 98, 6, 97, 6, 98, 6, 99, 6, 100], [6, 98, 6, 99, 6, 96, 6, 97, 5, 96, 5, 97], [4, 98, 4, 99, 7, 98, 7, 99, 7, 100, 7, 101], [8, 98, 8, 99, 8, 96, 8, 97, 3, 96, 3, 97], [1, 99, 1, 100, 2, 99, 2, 100, 2, 101, 2, 102], [3, 99, 3, 100, 3, 97, 3, 98, 4, 97, 4, 98], [7, 99, 7, 100, 8, 99, 8, 100, 8, 101, 8, 102], [0, 100, 0, 101, 0, 98, 0, 99, 5, 98, 5, 99], [4, 100, 4, 101, 1, 100, 1, 101, 1, 102, 1, 103], [2, 100, 2, 101, 2, 98, 2, 99, 3, 98, 3, 99], [1, 101, 1, 102, 0, 101, 0, 102, 0, 103, 0, 104], [5, 101, 5, 102, 5, 99, 5, 100, 4, 99, 4, 100], [7, 101, 7, 102, 6, 101, 6, 102, 6, 103, 6, 104], [6, 102, 6, 103, 6, 100, 6, 101, 5, 100, 5, 101], [4, 102, 4, 103, 7, 102, 7, 103, 7, 104, 7, 105], [8, 102, 8, 103, 8, 100, 8, 101, 3, 100, 3, 101], [1, 103, 1, 104, 2, 103, 2, 104, 2, 105, 2, 106], [3, 103, 3, 104, 3, 101, 3, 102, 4, 101, 4, 102], [7, 103, 7, 104, 8, 103, 8, 104, 8, 105, 8, 106], [0, 104, 0, 105, 0, 102, 0, 103, 5, 102, 5, 103], [4, 104, 4, 105, 1, 104, 1, 105, 1, 106, 1, 107], [2, 104, 2, 105, 2, 102, 2, 103, 3, 102, 3, 103], [1, 105, 1, 106, 0, 105, 0, 106, 0, 107, 0, 108], [5, 105, 5, 106, 5, 103, 5, 104, 4, 103, 4, 104], [7, 105, 7, 106, 6, 105, 6, 106, 6, 107, 6, 108], [6, 106, 6, 107, 6, 104, 6, 105, 5, 104, 5, 105], [4, 106, 4, 107, 7, 106, 7, 107, 7, 108, 7, 109], [8, 106, 8, 107, 8, 104, 8, 105, 3, 104, 3, 105], [1, 107, 1, 108, 2, 107, 2, 108, 2, 109, 2, 110], [3, 107, 3, 108, 3, 105, 3, 106, 4, 105, 4, 106], [7, 107, 7, 108, 8, 107, 8, 108, 8, 109, 8, 110], [0, 108, 0, 109, 0, 106, 0, 107, 5, 106, 5, 107], [4, 108, 4, 109, 1, 108, 1, 109, 1, 110, 1, 111], [2, 108, 2, 109, 2, 106, 2, 107, 3, 106, 3, 107], [1, 109, 1, 110, 0, 109, 0, 110, 0, 111, 0, 112], [5, 109, 5, 110, 5, 107, 5, 108, 4, 107, 4, 108], [7, 109, 7, 110, 6, 109, 6, 110, 6, 111, 6, 112], [6, 110, 6, 111, 6, 108, 6, 109, 5, 108, 5, 109], [4, 110, 4, 111, 7, 110, 7, 111, 7, 112, 7, 113], [8, 110, 8, 111, 8, 108, 8, 109, 3, 108, 3, 109], [1, 111, 1, 112, 2, 111, 2, 112, 2, 113, 2, 114], [3, 111, 3, 112, 3, 109, 3, 110, 4, 109, 4, 110], [7, 111, 7, 112, 8, 111, 8, 112, 8, 113, 8, 114], [0, 112, 0, 113, 0, 110, 0, 111, 5, 110, 5, 11 1], [4, 112, 4, 113, 1, 112, 1, 113, 1, 114, 1, 115], [2, 112, 2, 113, 2, 110, 2, 111, 3, 110, 3, 11 1], [1, 113, 1, 114, 0, 113, 0, 114, 0, 115, 0, 116], [5, 113, 5, 114, 5, 111, 5, 112, 4, 111, 4, 112], [7, 113, 7, 114, 6, 113, 6, 114, 6, 115, 6, 116], [6, 114, 6, 115, 6, 112, 6, 113, 5, 112, 5, 113], [4, 114, 4, 115, 7, 114, 7, 115, 7, 116, 7, 117], [8, 114, 8, 115, 8, 112, 8, 113, 3, 112, 3, 113], [1, 115, 1, 116, 2, 115, 2, 116, 2, 117, 2, 118], [3, 115, 3, 116, 3, 113, 3, 114, 4, 113, 4, 114], [7, 115, 7, 116, 8, 115, 8, 116, 8, 117, 8, 118], [0, 116, 0, 117, 0, 114, 0, 115, 5, 114, 5, 115], [4, 116, 4, 117, 1, 116, 1, 117, 1, 118, 1, 119], [2, 116, 2, 117, 2, 114, 2, 115, 3, 114, 3, 115], [1, 117, 1, 118, 0, 117, 0, 118, 0, 119, 0, 120], [5, 117, 5, 118, 5, 115, 5, 116, 4, 115, 4, 116], [7, 117, 7, 118, 6, 117, 6, 118, 6, 119, 6, 120], [6, 118, 6, 119, 6, 116, 6, 117, 5, 116, 5, 117], [4, 118, 4, 119, 7, 118, 7, 119, 7, 120, 7, 121], [8, 118, 8, 119, 8, 116, 8, 117, 3, 116, 3, 117], [1, 119, 1, 120, 2, 119, 2, 120, 2, 121, 2, 122], [3, 119, 3, 120, 3, 117, 3, 118, 4, 117, 4, 118], [7, 119, 7, 120, 8, 119, 8, 120, 8, 121, 8, 122], [0, 120, 0, 121, 0, 118, 0, 119, 5, 118, 5, 119], [4, 120, 4, 121, 1, 120, 1, 121, 1, 122, 1, 123], [2, 120, 2, 121, 2, 118, 2, 119, 3, 118, 3, 119], [1, 121, 1, 122, 0, 121, 0, 122, 0, 123, 0, 124], [5, 121, 5, 122, 5, 119, 5, 120, 4, 119, 4, 120], [7, 121, 7, 122, 6, 121, 6, 122, 6, 123, 6, 124], [6, 122, 6, 123, 6, 120, 6, 121, 5, 120, 5, 121], [4, 122, 4, 123, 7, 122, 7, 123, 7, 124, 7, 125], [8, 122, 8, 123, 8, 120, 8, 121, 3, 120, 3, 121], [1, 123, 1, 124, 2, 123, 2, 124, 2, 125, 2, 126], [3, 123, 3, 124, 3, 121, 3, 122, 4, 121, 4, 122], [7, 123, 7, 124, 8, 123, 8, 124, 8, 125, 8, 126], [0, 124, 0, 125, 0, 122, 0, 123, 5, 122, 5, 123], [4, 124, 4, 125, 1, 124, 1, 125, 1, 126, 1, 127], [2, 124, 2, 125, 2, 122, 2, 123, 3, 122, 3, 123], [1, 125, 1, 126, 0, 125, 0, 126, 0, 127, 0, 128], [5, 125, 5, 126, 5, 123, 5, 124, 4, 123, 4, 124], [7, 125, 7, 126, 6, 125, 6, 126, 6, 127, 6, 128], [6, 126, 6, 127, 6, 124, 6, 125, 5, 124, 5, 125], [8, 126, 8, 127, 8, 124, 8, 125, 3, 124, 3, 125], [3, 127, 3, 128, 3, 125, 3, 126, 4, 125, 4, 126]

TABLE 14B

[4, 126, 4, 127, 7, 126, 7, 127, 7, 128, 0, 0], [1, 127, 1, 128, 2, 127, 2, 128], [5, 127, 5, 128, 4, 127, 4, 128], [7, 127, 7, 128, 8, 127, 8, 128], [4, 128, 0, 0, 1, 128, 0, 0], [6, 128, 0, 0, 5, 128, 0, 0], [8, 128, 0, 0, 3, 128, 0, 0], [0, 128, 0, 0, 0, 126, 0, 127, 5, 126, 5, 127], [2, 128, 0, 0, 2, 126, 2, 127, 3, 126, 3, 127]

The core oligonucleotide sequences used to produce 4H×4H×32B nucleic acid structures of the invention are designated SEQ ID NOs. 3249-3272, and the corresponding voxel coordinates are shown respectively in Table 15A. The end oligonucleotide sequences used to produce 4H×4H×32B nucleic acid structures of the invention are designated SEQ ID NOs. 3633-3646, and the corresponding voxel coordinates are shown respectively in Table 15B. (See also Appendix, Table 8 of U.S. provisional application No. 61/675,309, filed Jul. 24, 2012, incorporated by reference herein.)

TABLE 15A

[0, 0, 0, 1, 0, 0, 0, 0], [0, 0, 2, 1, 0, 0, 0, 0], [0, 0, 13, 1, 0, 0, 0, 0], [0, 0, 15, 1, 0, 0, 0, 0], [0, 0, 8, 1, 0, 0, 7, 1], [0, 0, 10, 1, 0, 0, 5, 1], [0, 0, 6, 1, 0, 0, 1, 1, 1, 2, 1, 3], [0, 0, 4, 1, 0, 0, 3, 1, 3, 2, 3, 3], [4, 1, 4, 2, 0, 0, 0, 0], [7, 1, 7, 2, 0, 0, 0, 0], [12, 1, 12, 2, 0, 0, 0, 0], [15, 1, 15, 2, 0, 0, 0, 0], [5, 1, 5, 2, 6, 1, 6, 2], [13, 1, 13, 2, 14, 1, 14, 2], [1, 1, 1, 2, 0, 1, 0, 2, 0, 3, 0, 4], [9, 1, 9, 2, 8, 1, 8, 2, 8, 3, 8, 4], [4, 2, 4, 3, 11, 2, 11, 3], [6, 2, 6, 3, 9, 2, 9, 3], [12, 2, 12, 3, 0, 0, 12, 1, 0, 0, 11, 1], [14, 2, 14, 3, 0, 0, 14, 1, 0, 0, 9, 1], [1, 3, 1, 4, 2, 3, 2, 4], [9, 3, 9, 4, 10, 3, 10, 4], [3, 3, 3, 4, 3, 1, 3, 2, 2, 1, 2, 2], [1 1, 3, 11, 4, 11, 1, 11, 2, 10, 1, 10, 2]

TABLE 15B

[10, 2, 10, 3, 13, 2, 13, 3, 13, 4, 0, 0], [8, 2, 8, 3, 15, 2, 15, 3, 15, 4, 0, 0], [5, 3, 5, 4, 4, 3, 4, 4], [7, 3, 7, 4, 6, 3, 6, 4], [13, 3, 13, 4, 12, 3, 12, 4], [15, 3, 15, 4, 14, 3, 14, 4], [4, 4, 0, 0, 3, 4, 0, 0], [6, 4, 0, 0, 1, 4, 0, 0], [8, 4, 0, 0, 7, 4, 0, 0], [10, 4, 0, 0, 5, 4, 0, 0], [12, 4, 0, 0, 11, 4, 0, 0], [14, 4, 0, 0, 9, 4, 0, 0], [0, 4, 0, 0, 0, 2, 0, 3, 7, 2, 7, 3], [2, 4, 0, 0, 2, 2, 2, 3, 5, 2, 5, 3]

The core oligonucleotide sequences used to produce 4H×4H×64B nucleic acid structures of the invention are designated SEQ ID NOs. 3249-3296, and the corresponding voxel coordinates are shown respectively in Table 16A. The end oligonucleotide sequences used to produce 4H×4H×64B nucleic acid structures of the invention are designated SEQ ID NOs. 3647-3660, and the corresponding voxel coordinates are shown respectively in Table 16B. (See also Appendix, Table 8 of U.S. provisional application No. 61/675,309, filed Jul. 24, 2012, incorporated by reference herein.)

TABLE 16A

[0, 0, 0, 1, 0, 0, 0, 0], [0, 0, 2, 1, 0, 0, 0, 0], [0, 0, 13, 1, 0, 0, 0, 0], [0, 0, 15, 1, 0, 0, 0, 0], [0, 0, 8, 1, 0, 0, 7, 1], [0, 0, 10, 1, 0, 0, 5, 1], [0, 0, 6, 1, 0, 0, 1, 1, 1, 2, 1, 3], [0, 0, 4, 1, 0, 0, 3, 1, 3, 2, 3, 3], [4, 1, 4, 2, 0, 0, 0, 0], [7, 1, 7, 2, 0, 0, 0, 0], [12, 1, 12, 2, 0, 0, 0, 0], [15, 1, 15, 2, 0, 0, 0, 0], [5, 1, 5, 2, 6, 1, 6, 2], [13, 1, 13, 2, 14, 1, 14, 2], [1, 1, 1, 2, 0, 1, 0, 2, 0, 3, 0, 4], [9, 1, 9, 2, 8, 1, 8, 2, 8, 3, 8, 4], [4, 2, 4, 3, 11, 2, 11, 3], [6, 2, 6, 3, 9, 2, 9, 3], [12, 2, 12, 3, 0, 0, 12, 1, 0, 0, 11, 1], [14, 2, 14, 3, 0, 0, 14, 1, 0, 0, 9, 1], [1, 3, 1, 4, 2, 3, 2, 4], [9, 3, 9, 4, 10, 3, 10, 4], [3, 3, 3, 4, 3, 1, 3, 2, 2, 1, 2, 2], [11, 3, 11, 4, 11, 1, 11, 2, 10, 1, 10, 2], [10, 2, 10, 3, 13, 2, 13, 3, 13, 4, 13, 5], [8, 2, 8, 3, 15, 2, 15, 3, 15, 4, 15, 5], [5, 3, 5, 4, 4, 3, 4, 4, 4, 5, 4, 6], [13, 3, 13, 4, 12, 3, 12, 4, 12, 5, 12, 6], [8, 4, 8, 5, 7, 4, 7, 5], [10, 4, 10, 5, 5, 4, 5, 5], [0, 4, 0, 5, 0, 2, 0, 3, 7, 2, 7, 3], [6, 4, 6, 5, 1, 4, 1, 5, 1, 6, 1, 7], [2, 4, 2, 5, 2, 2, 2, 3, 5, 2, 5, 3], [4, 4, 4, 5, 3, 4, 3, 5, 3, 6, 3, 7], [5, 5, 5, 6, 6, 5, 6, 6], [13, 5, 13, 6, 14, 5, 14, 6], [1, 5, 1, 6, 0, 5, 0, 6, 0, 7, 0, 8], [7, 5, 7, 6, 7, 3, 7, 4, 6, 3, 6, 4], [9, 5, 9, 6, 8, 5, 8, 6, 8, 7, 8, 8], [15, 5, 15, 6, 15, 3, 15, 4, 14, 3, 14, 4], [4, 6, 4, 7, 11, 6, 11, 7], [6, 6, 6, 7, 9, 6, 9, 7], [12, 6, 12, 7, 12, 4, 12, 5, 11, 4, 11, 5], [14, 6, 14, 7, 14, 4, 14, 5, 9, 4, 9, 5], [1, 7, 1, 8, 2, 7, 2, 8], [9, 7, 9, 8, 10, 7, 10, 8], [3, 7, 3, 8, 3, 5, 3, 6, 2, 5, 2, 6], [11, 7, 11, 8, 11, 5, 11, 6, 10, 5, 10, 6]

TABLE 16B

[10, 6, 10, 7, 13, 6, 13, 7, 13, 8, 0, 0], [8, 6, 8, 7, 15, 6, 15, 7, 15, 8, 0, 0], [5, 7, 5, 8, 4, 7, 4, 8], [7, 7, 7, 8, 6, 7, 6, 8], [13, 7, 13, 8, 12,7, 12, 8], [15, 7, 15, 8, 14, 7, 14, 8], [4, 8, 0, 0, 3, 8, 0, 0], [6, 8, 0, 0, 1, 8, 0, 0], [8, 8, 0, 0, 7, 8, 0, 0], [10, 8, 0, 0, 5, 8, 0, 0], [12, 8, 0, 0, 11, 8, 0, 0], [14, 8, 0, 0, 9, 8, 0, 0], [0, 8, 0, 0, 0, 6, 0, 7, 7, 6, 7, 7], [2, 8, 0, 0, 2, 6, 2, 7, 5, 6, 5, 7]

The core oligonucleotide sequences used to produce 4H×4H×128B nucleic acid structures of the invention are designated SEQ ID NOs. 3249-3344, and the corresponding voxel coordinates are shown respectively in Table 17A. The end oligonucleotide sequences used to produce 4H×4H×128B nucleic acid structures of the invention are designated SEQ ID NOs. 3661-3674, and the corresponding voxel coordinates are shown respectively in Table 17B. (See also Appendix, Table 8 of U.S. provisional application No. 61/675,309, filed Jul. 24, 2012, incorporated by reference herein.)

TABLE 17A

[0, 0, 0, 1, 0, 0, 0, 0], [0, 0, 2, 1, 0, 0, 0, 0], [0, 0, 13, 1, 0, 0, 0, 0], [0, 0, 15, 1, 0, 0, 0, 0], [0, 0, 8, 1, 0, 0, 7, 1], [0, 0, 10, 1, 0, 0, 5, 1], [0, 0, 6, 1, 0, 0, 1, 1, 1, 2, 1, 3], [0, 0, 4, 1, 0, 0, 3, 1, 3, 2, 3, 3], [4, 1, 4, 2, 0, 0, 0, 0], [7, 1, 7, 2, 0, 0, 0, 0], [12, 1, 12, 2, 0, 0, 0, 0], [15, 1, 15, 2, 0, 0, 0, 0], [5, 1, 5, 2, 6, 1, 6, 2], [13, 1, 13, 2, 14, 1, 14, 2], [1, 1, 1, 2, 0, 1, 0, 2, 0, 3, 0, 4], [9, 1, 9, 2, 8, 1, 8, 2, 8, 3, 8, 4], [4, 2, 4, 3, 11, 2, 11, 3], [6, 2, 6, 3, 9, 2, 9, 3], [12, 2, 12, 3, 0, 0, 12, 1, 0, 0, 11, 1], [14, 2, 14, 3, 0, 0, 14, 1, 0, 0, 9, 1], [1, 3, 1, 4, 2, 3, 2, 4], [9, 3, 9, 4, 10, 3, 10, 4], [3, 3, 3, 4, 3, 1, 3, 2, 2, 1, 2, 2], [11, 3, 11, 4, 11, 1, 11, 2, 10, 1, 10, 2], [10, 2, 10, 3, 13, 2, 13, 3, 13, 4, 13, 5], [8, 2, 8, 3, 15, 2, 15, 3, 15, 4, 15, 5], [5, 3, 5, 4, 4, 3, 4, 4, 4, 5, 4, 6], [13, 3, 13, 4, 12, 3, 12, 4, 12, 5, 12, 6], [8, 4, 8, 5, 7, 4, 7, 5], [10, 4, 10, 5, 5, 4, 5, 5], [0, 4, 0, 5, 0, 2, 0, 3, 7, 2, 7, 3], [6, 4, 6, 5, 1, 4, 1, 5, 1, 6, 1, 7], [2, 4, 2, 5, 2, 2, 2, 3, 5, 2, 5, 3], [4, 4, 4, 5, 3, 4, 3, 5, 3, 6, 3, 7], [5, 5, 5, 6, 6, 5, 6, 6], [13, 5, 13, 6, 14, 5, 14, 6], [1, 5, 1, 6, 0, 5, 0, 6, 0, 7, 0, 8], [7, 5, 7, 6, 7, 3, 7, 4, 6, 3, 6, 4], [9, 5, 9, 6, 8, 5, 8, 6, 8, 7, 8, 8], [15, 5, 15, 6, 15, 3, 15, 4, 14, 3, 14, 4], [4, 6, 4, 7, 11, 6, 11, 7], [6, 6, 6, 7, 9, 6, 9, 7], [12, 6, 12, 7, 12, 4, 12, 5, 11, 4, 11, 5], [14, 6, 14, 7, 14, 4, 14, 5, 9, 4, 9, 5], [1, 7, 1, 8, 2, 7, 2, 8], [9, 7, 9, 8, 10, 7, 10, 8], [3, 7, 3, 8, 3, 5, 3, 6, 2, 5, 2, 6], [11, 7, 11, 8, 11, 5, 11, 6, 10, 5, 10, 6], [10, 6, 10, 7, 13, 6, 13, 7, 13, 8, 13, 9], [8, 6, 8, 7, 15, 6, 15, 7, 15, 8, 15, 9], [5, 7, 5, 8, 4, 7, 4, 8, 4, 9, 4, 10], [13, 7, 13, 8, 12, 7, 12, 8, 12, 9, 12, 10], [8, 8, 8, 9, 7, 8, 7, 9], [10, 8, 0, 0, 9, 0, 0, 6, 0, 7, 7, 6, 7, 7], [6, 8, 6, 9, 1, 8, 1, 9, 1, 10, 1, 11], [2, 8, 2, 9, 2, 6, 2, 7, 5, 6, 5, 7], [4, 8, 4, 9, 3, 8, 3, 9, 3, 10, 3, 11], [5, 9, 5, 10, 6, 9, 6, 10], [13, 9, 13, 10, 14, 9, 14, 10], [1, 9, 1, 10, 0, 9, 0, 10, 0, 11, 0, 12], [7, 9, 7, 10, 7, 7, 7, 8, 6, 7, 6, 8], [9, 9, 9, 10, 8, 9, 8, 10, 8, 11, 8, 12], [15, 9, 15, 10, 15, 7, 15, 8, 14, 7, 14, 8], [4, 10, 4, 11, 11, 10, 11, 11], [6, 10, 6, 11, 9, 10, 9, 11], [12, 10, 12, 11, 12, 8, 12, 9, 11, 8, 11, 9], [10, 10, 10, 11, 13, 10, 13, 11, 13, 12, 13, 13], [14, 10, 14, 11, 14, 8, 14, 9, 9, 8, 9, 9], [8, 10, 8, 11, 15, 10, 15, 11, 15, 12, 15, 13], [1, 11, 1, 12, 2, 11, 2, 12], [9, 11, 9, 12, 10, 11, 10, 12], [3, 11, 3, 12, 3, 9, 3, 10, 2, 9, 2, 10], [5, 11, 5, 12, 4, 11, 4, 12, 4, 13, 4, 14], [1 1, 11, 11, 12, 11,

TABLE 17A-continued 9, 11, 10, 10, 9, 10, 10], [13, 11, 13, 12, 12, 11, 12, 12, 12, 13, 12, 14], [8, 12, 8, 13, 7, 12, 7, 13], [10, 12, 10, 13, 5, 12, 5, 13], [0, 12, 0, 13, 0, 10, 0, 11, 7, 10, 7, 11], [6, 12, 6, 13, 1, 12, 1, 13, 1, 14, 1, 15], [2, 12, 2, 13, 2, 10, 2, 11, 5, 10, 5, 11], [4, 12, 4, 13, 3, 12, 3, 13, 3, 14, 3, 15], [5, 13, 5, 14, 6, 13, 6, 14], [13, 13, 13, 14, 14, 13, 14, 14], [1, 13, 1, 14, 0, 13, 0, 14, 0, 15, 0, 16], [7, 13, 7, 14, 7, 11, 7, 12, 6, 11, 6, 12], [9, 13, 9, 14, 8, 13, 8, 14, 8, 15, 8, 16], [15, 13, 15, 14, 15, 11, 15, 12, 14, 11, 14, 12], [4, 14, 4, 15, 11, 14, 11, 15], [6, 14, 6, 15, 9, 14, 9, 15], [12, 14, 12, 15, 12, 12, 12, 13, 11, 12, 11, 13], [14, 14, 14, 15, 14, 12, 14, 13, 9, 12, 9, 13], [1, 15, 1, 16, 2, 15, 2, 16], [9, 15, 9, 16, 10, 15, 10, 16], [3, 15, 3, 16, 3, 13, 3, 14, 2, 13, 2, 14], [11, 15, 11, 16, 11, 13, 11, 14, 10, 13, 10, 14]

TABLE 17B

[10, 14, 10, 15, 13, 14, 13, 15, 13, 16, 0, 0], [8, 14, 8, 15, 15, 14, 15, 15, 15, 16, 0, 0], [5, 15, 5, 16, 4, 15, 4, 16], [7, 15, 7, 16, 6, 15, 6, 16], [13, 15, 13, 16, 12, 15, 12, 16], [15, 15, 15, 16, 14, 15, 14, 16], [4, 16, 0, 0, 3, 16, 0, 0], [6, 16, 0, 0, 1, 16, 0, 0], [8, 16, 0, 0, 7, 16, 0, 0], [10, 16, 0, 0, 5, 16, 0, 0], [12, 16, 0, 0, 11, 16, 0, 0], [14, 16, 0, 0, 9, 16, 0, 0], [0, 16, 0, 0, 0, 14, 0, 15, 7, 14, 7, 15], [2, 16, 0, 0, 2, 14, 2, 15, 5, 14, 5, 15]

The core oligonucleotide sequences used to produce 4H×4H×256B nucleic acid structures of the invention are designated SEQ ID NOs. 3249-3440, and the corresponding voxel coordinates are shown respectively in Table 18A. The end oligonucleotide sequences used to produce 4H×4H×256B nucleic acid structures of the invention are designated SEQ ID NOs. 3675-3688, and the corresponding voxel coordinates are shown respectively in Table 18B. (See also Appendix, Table 8 of U.S. provisional application No. 61/675,309, filed Jul. 24, 2012, incorporated by reference herein.)

TABLE 18A

[0, 0, 0, 1, 0, 0, 0, 0], [0, 0, 2, 1, 0, 0, 0, 0], [0, 0, 13, 1, 0, 0, 0, 0], [0, 0, 15, 1, 0, 0, 0, 0], [0, 0, 8, 1, 0, 0, 7, 1], [0, 0, 10, 1, 0, 0, 5, 1], [0, 0, 6, 1, 0, 0, 1, 1, 1, 2, 1, 3], [0, 0, 4, 1, 0, 0, 3, 1, 3, 2, 3, 3], [4, 1, 4, 2, 0, 0, 0, 0], [7, 1, 7, 2, 0, 0, 0, 0], [12, 1, 12, 2, 0, 0, 0, 0], [15, 1, 15, 2, 0, 0, 0, 0], [5, 1, 5, 2, 6, 1, 6, 2], [13, 1, 13, 2, 14, 1, 14, 2], [1, 1, 1, 2, 0, 1, 0, 2, 0, 3, 0, 4], [9, 1, 9, 2, 8, 1, 8, 2, 8, 3, 8, 4], [4, 2, 4, 3, 11, 2, 11, 3], [6, 2, 6, 3, 9, 2, 9, 3], [12, 2, 12, 3, 0, 0, 12, 1, 0, 0, 11, 1], [14, 2, 14, 3, 0, 0, 14, 1, 0, 0, 9, 1], [1, 3, 1, 4, 2, 3, 2, 4], [9, 3, 9, 4, 10, 3, 10, 4], [3, 3, 3, 4, 3, 1, 3, 2, 2, 1, 2, 2], [11, 3, 11, 4, 11, 1, 11, 2, 10, 1, 10, 2], [10, 2, 10, 3, 13, 2, 13, 3, 13, 4, 13, 5], [8, 2, 8, 3, 15, 2, 15, 3, 15, 4, 15, 5], [5, 3, 5, 4, 4, 3, 4, 4, 4, 5, 4, 6], [13, 3, 13, 4, 12, 3, 12, 4, 12, 5, 12, 6], [8, 4, 8, 5, 7, 4, 7, 5], [10, 4, 10, 5, 5, 4, 5, 5], [0, 4, 0, 5, 0, 2, 0, 3, 7, 2, 7, 3], [6, 4, 6, 5, 1, 4, 1, 5, 1, 6, 1, 7], [2, 4, 2, 5, 2, 2, 2, 3, 5, 2, 5, 3], [4, 4, 4, 5, 3, 4, 3, 5, 3, 6, 3, 7], [5, 5, 5, 6, 6, 5, 6, 6], [13, 5, 13, 6, 14, 5, 14, 6], [1, 5, 1, 6, 0, 5, 0, 6, 0, 7, 0, 8], [7, 5, 7, 6, 7, 3, 7, 4, 6, 3, 6, 4], [9, 5, 9, 6, 8, 5, 8, 6, 8, 7, 8, 8], [15, 5, 15, 6, 15, 3, 15, 4, 14, 3, 14, 4], [4, 6, 4, 7, 11, 6, 11, 7], [6, 6, 6, 7, 9, 6, 9, 7], [12, 6, 12, 7, 12, 4, 12, 5, 11, 4, 11, 5], [14, 6, 14, 7, 14, 4, 14, 5, 9, 4, 9, 5], [1, 7, 1, 8, 2, 7, 2, 8], [9, 7, 9, 8, 10, 7, 10, 8], [3, 7, 3, 8, 3, 5, 3, 6, 2, 5, 2, 6], [11, 7, 11, 8, 11, 5, 11, 6, 10, 5, 10, 6], [10, 6, 10, 7, 13, 6, 13, 7, 13, 8, 13, 9], [8, 6, 8, 7, 15, 6, 15, 7, 15, 8, 15, 9], [5, 7, 5, 8, 4, 7, 4, 8, 4, 9, 4, 10], [13, 7, 13, 8, 12, 7, 12, 8, 12, 9, 12, 10], [8, 8, 8, 9, 7, 8, 7, 9], [10, 8, 10, 9, 5, 8, 5, 9], [0, 8, 0, 9, 0, 6, 0, 7, 7, 6, 7, 7], [6, 8, 6, 9, 1, 8, 1, 9, 1, 10, 1, 11], [2, 8, 2, 9, 2, 6, 2, 7, 5, 6, 5, 7], [4, 8, 4, 9, 3, 8, 3, 9, 3, 10, 3, 11], [5, 9, 5, 10, 6, 9, 6, 10], [13, 9, 13, 10, 14, 9, 14, 10], [1, 9, 1, 10, 0, 9, 0, 10, 0, 11, 0, 12], [7, 9, 7, 10, 7, 7, 7, 8, 6, 7, 6, 8], [9, 9, 9, 10, 8, 9, 8, 10, 8, 11, 8, 12], [15, 9, 15, 10, 15, 7, 15, 8, 14, 7, 14, 8], [4, 10, 4, 11, 11, 10, 11, 11], [6, 10, 6, 11, 9, 10, 9, 11], [12, 10, 12, 11, 12, 8, 12, 9, 11, 8, 11, 9], [10, 10, 10, 11, 13, 10, 13, 11, 13, 12, 13, 13], [14, 10, 14, 11, 14, 8, 14, 9, 9, 8, 9, 9], [8, 10, 8, 11, 15, 10, 15, 11, 15, 12, 15, 13], [1, 11, 1, 12, 2, 11, 2, 12], [9, 11, 9, 12, 10, 11, 10, 12], [3, 11, 3, 12, 3, 9, 3, 10, 2, 9, 2, 10], [5, 11, 5, 12, 4, 11, 4, 12, 4, 13, 4, 14], [1, 1, 11, 11, 12, 11, 9, 11, 10, 10, 9, 10, 10], [13, 11, 13, 12, 12, 11, 12, 12, 12, 13, 12, 14], [8, 12, 8, 13, 7, 12, 7, 13], [10, 12, 10, 13, 5, 12, 5, 13], [0, 12, 0, 13, 0, 10, 0, 11, 7, 10, 7, 11], [6, 12, 6, 13, 1, 12, 1, 13, 1, 14, 1, 15], [2, 12, 2, 13, 2, 10, 2, 11, 5, 10, 5, 11], [4, 12, 4, 13, 3, 12, 3, 13, 3, 14, 3, 15], [5, 13, 5, 14, 6, 13, 6, 14], [13, 13, 13, 14, 14, 13, 14, 14], [1, 13, 1, 14, 0, 13, 0, 14, 0, 15, 0, 16], [7, 13, 7, 14, 7, 11, 7, 12, 6, 11, 6, 12], [9, 13, 9, 14, 8, 13, 8, 14, 8, 15, 8, 16], [15, 13, 15, 14, 15, 11, 15, 12, 14, 11, 14, 12], [4, 14, 4, 15, 11, 14, 11, 15], [6, 14, 6, 15, 9, 14, 9, 15], [12, 14, 12, 15, 12, 12, 12, 13, 11, 12, 11, 13], [14, 14, 14, 15, 14, 12, 14, 13, 9, 12, 9, 13], [1, 15, 1, 16, 2, 15, 2, 16], [9, 15, 9, 16, 10, 15, 10, 16], [3, 15, 3, 16, 3, 13, 3, 14, 2, 13, 2, 14], [11, 15, 11, 16, 11, 13, 11, 14, 10, 13, 10, 14], [10, 14, 10, 15, 13, 14, 13, 15, 13, 16, 13, 17], [8, 14, 8, 15, 15, 14, 15, 15, 15, 16, 15, 17], [5, 15, 5, 16, 4, 15, 4, 16, 4, 17, 4, 18], [13, 15, 13, 16, 12, 15, 12, 16, 12, 17, 12, 18], [8, 16, 8, 17, 7, 16, 7, 17], [10, 16, 10, 17, 5, 16, 5, 17], [0, 16, 0, 17, 0, 14, 0, 15, 7, 14, 7, 15], [6, 16, 6, 17, 1, 16, 1, 17, 1, 18, 1, 19], [2, 16, 2, 17, 2, 14, 2, 15, 5, 14, 5, 15], [4, 16, 4, 17, 3, 16, 3, 17, 3, 18, 3, 19], [5, 17, 5, 18, 6, 17, 6, 18], [13, 17, 13, 18, 14, 17, 14, 18], [1, 17, 1, 18, 0, 17, 0, 18, 0, 19, 0, 20], [7, 17, 7, 18, 7, 15, 7, 16, 6, 15, 6, 16], [9, 17, 9, 18, 8, 17, 8, 18, 8, 19, 8, 20], [15, 17, 15, 18, 15, 15, 15, 16, 14, 15, 14, 16], [4, 18, 4, 19, 11, 18, 11, 19], [6, 18, 6, 19, 9, 18, 9, 19], [12, 18, 12, 19, 12, 16, 12, 17, 11, 16, 11, 17], [10, 18, 10, 19, 13, 18, 13, 19, 13, 20, 13, 21], [14, 18, 14, 19, 14, 16, 14, 17, 9, 16, 9, 17], [8, 18, 8, 19, 15, 18, 15, 19, 15, 20, 15, 21], [1, 19, 1, 20, 2, 19, 2, 20], [9, 19, 9, 20, 10, 19, 10, 20], [3, 19, 3, 20, 3, 17, 3, 18, 2, 17, 2, 18], [5, 19, 5, 20, 4, 19, 4, 20, 4, 21, 4, 22], [11, 19, 11, 20, 11, 17, 11, 18, 10, 17, 10, 18], [13, 19, 13, 20, 12, 19, 12, 20, 12, 21, 12, 22], [8, 20, 8, 21, 7, 20, 7, 21], [10, 20, 10, 21, 5, 20, 5, 21], [0, 20, 0, 21, 0, 18, 0, 19, 7, 18, 7, 19], [6, 20, 6, 21, 1, 20, 1, 21, 1, 22, 1, 23], [2, 20, 2, 21, 2, 18, 2, 19, 5, 18, 5, 19], [4, 20, 4, 21, 3, 20, 3, 21, 3, 22, 3, 23], [5, 21, 5, 22, 6, 21, 6, 22], [13, 21, 13, 22, 14, 21, 14, 22], [1, 21, 1, 22, 0, 21, 0, 22, 0, 23, 0, 24], [7, 21, 7, 22, 7, 19, 7, 20, 6, 19, 6, 20], [9, 21, 9, 22, 8, 21, 8, 22, 8, 23, 8, 24], [15, 21, 15, 22, 15, 19, 15, 20, 14, 19, 14, 20], [4, 22, 4, 23, 11, 22, 11, 23], [6, 22, 6, 23, 9, 22, 9, 23], [12, 22, 12, 23, 12, 20, 12, 21, 11, 20, 11, 21], [10, 22, 10, 23, 13, 22, 13, 23, 13, 24, 13, 25], [14, 22, 14, 23, 14, 20, 14, 21, 9, 20, 9, 21], [8, 22, 8, 23, 15, 22, 15, 23, 15, 24, 15, 25], [1, 23, 1, 24, 2, 23, 2, 24], [9, 23, 9, 24, 10, 23, 10, 24], [3, 23, 3, 24, 3, 21, 3, 22, 2, 21, 2, 22], [5, 23, 5, 24, 4, 23, 4, 24, 4, 25, 4, 26], [11, 23, 11, 24, 11, 21, 11, 22, 10, 21, 10, 22], [13, 23, 13, 24, 12, 23, 12, 24, 12, 25, 12, 26], [8, 24, 8, 25, 7, 24, 7, 25], [10, 24, 10, 25, 5, 24, 5, 25], [0, 24, 0, 25, 0, 22, 0, 23, 7, 22, 7, 23], [6, 24, 6, 25, 1, 24, 1, 25, 1, 26, 1, 27], [2, 24, 2, 25, 2, 22, 2, 23, 5, 22, 5, 23], [4, 24, 4, 25, 3, 24, 3, 25, 3, 26, 3, 27], [5, 25, 5, 26, 6, 25, 6, 26], [13, 25, 13, 26, 14, 25, 14, 26], [1, 25, 1, 26, 0, 25, 0, 26, 0, 27, 0, 28], [7, 25, 7, 26, 7, 23, 7, 24, 6, 23, 6, 24], [9, 25, 9, 26, 8, 25, 8, 26, 8, 27, 8, 28], [15, 25, 15, 26, 15, 23, 15, 24, 14, 23, 14, 24], [4, 26, 4, 27, 11, 26, 11, 27], [6, 26, 6, 27, 9, 26, 9, 27], [12, 26, 12, 27, 12, 24, 12, 25, 11, 24, 11, 25], [10, 26, 10, 27, 13, 26, 13, 27, 13, 28, 13, 29], [14, 26, 14, 27, 14, 24, 14, 25, 9, 24, 9, 25], [8, 26, 8, 27, 15, 26, 15, 27, 15, 28, 15, 29], [1, 27, 1, 28, 2, 27, 2, 28], [9, 27, 9, 28, 10, 27, 10, 28], [3, 27, 3, 28, 3, 25, 3, 26, 2, 25, 2, 26], [5, 27, 5, 28, 4, 27, 4, 28, 4, 29, 4, 30], [11, 27, 11, 28, 11, 25, 11, 26, 10, 25, 10, 26], [13, 27, 13, 28, 12, 27, 12, 28, 12, 29, 12, 30], [8, 28, 8, 29, 7, 28, 7, 29], [10, 28, 10, 29, 5, 28, 5, 29], [0, 28, 0, 29, 0, 26, 0, 27, 7, 26, 7, 27], [6, 28, 6, 29, 1, 28, 1, 29, 1, 30, 1, 31], [2, 28, 2, 29, 2, 26, 2, 27, 5, 26, 5, 27], [4, 28, 4, 29, 3, 28, 3, 29, 3, 30, 3, 31], [5, 29, 5, 30, 6, 29, 6, 30], [13, 29, 13, 30, 14, 29, 14, 30], [1, 29, 1, 30, 0, 29, 0, 30, 0, 31, 0, 32], [7, 29, 7, 30, 7, 27, 7, 28, 6, 27, 6, 28], [9, 29, 9, 30, 8, 29, 8, 30, 8, 31, 8, 32], [15, 29, 15, 30, 15, 27, 15, 28, 14, 27, 14, 28], [4, 30, 4, 31, 11, 30, 11, 31], [6, 30, 6, 31, 9, 30, 9, 31], [12, 30, 12, 31, 12, 28, 12, 29, 11, 28, 11, 29], [14, 30, 14, 31, 14, 28, 14, 29, 9, 28, 9, 29], [1, 31, 1, 32, 2, 31, 2, 32], [9, 31, 9, 32, 10, 31, 10, 32], [3, 31, 3, 32, 3, 29, 3, 30, 2, 29, 2, 30], [11, 31, 11, 32, 11, 29, 11, 30, 10, 29, 10, 30]

TABLE 18B

[10, 30, 10, 31, 13, 30, 13, 31, 13, 32, 0, 0], [8, 30, 8, 31, 15, 30, 15, 31, 15, 32, 0, 0], [5, 31, 5, 32, 4, 31, 4, 32], [7, 31, 7, 32, 6, 31, 6, 32], [13, 31, 13, 32, 12, 31, 12, 32], [15, 31, 15, 32, 14, 31, 14, 32], [4, 32, 0, 0, 3, 32, 0, 0], [6, 32, 0, 0, 1, 32, 0, 0], [8, 32, 0, 0, 7, 32, 0, 0], [10, 32, 0, 0, 5, 32, 0, 0], [12, 32, 0, 0, 11, 32, 0, 0], [14, 32, 0, 0, 9, 32, 0, 0], [0, 32, 0, 0, 0, 30, 0, 31, 7, 30, 7, 31], [2, 32, 0, 0, 2, 30, 2, 31, 5, 30, 5, 31]

The core oligonucleotide sequences used to produce 4H×4H×512B nucleic acid structures of the invention are designated SEQ ID NOs. 3249-3632, and the corresponding voxel coordinates are shown respectively in Table 19A. The end oligonucleotide sequences used to produce 4H×4H× 512B nucleic acid structures of the invention are designated SEQ ID NOs. 3689-3702, and the corresponding voxel coordinates are shown respectively in Table 19B. (See also Appendix, Table 8 of U.S. provisional application No. 61/675,309, filed Jul. 24, 2012, incorporated by reference herein.)

TABLE 19A

[0, 0, 0, 1, 0, 0, 0, 0], [0, 0, 2, 1, 0, 0, 0, 0], [0, 0, 13, 1, 0, 0, 0, 0], [0, 0, 15, 1, 0, 0, 0, 0], [0, 0, 8, 1, 0, 0, 7, 1], [0, 0, 10, 1, 0, 0, 5, 1], [0, 0, 6, 1, 0, 0, 1, 1, 2, 1, 3], [0, 0, 4, 1, 0, 0, 3, 1, 3, 2, 3], [4, 1, 4, 2, 0, 0, 0, 0], [7, 1, 7, 2, 0, 0, 0, 0], [12, 1, 12, 2, 0, 0, 0, 0], [15, 1, 15, 2, 0, 0, 0, 0], [5, 1, 5, 2, 6, 1, 6, 2], [13, 1, 13, 2, 14, 1, 14, 2], [1, 1, 1, 2, 0, 1, 0, 2, 0, 3, 0, 4], [9, 1, 9, 2, 8, 1, 8, 2, 8, 3, 8, 4], [4, 2, 4, 3, 11, 2, 11, 3], [6, 2, 6, 3, 9, 2, 9, 3], [12, 2, 12, 3, 0, 0, 12, 1, 0, 0, 11, 1], [14, 2, 14, 3, 0, 0, 14, 1, 0, 0, 9, 1], [1, 3, 1, 4, 2, 3, 2, 4], [9, 3, 9, 4, 10, 3, 10, 4], [3, 3, 3, 4, 3, 1, 3, 2, 2, 1, 2, 2], [11, 3, 11, 4, 11, 1, 11, 2, 10, 1, 10, 2], [10, 2, 10, 3, 13, 2, 13, 3, 13, 4, 13, 5], [8, 2, 8, 3, 15, 2, 15, 3, 15, 4, 15, 5], [5, 3, 5, 4, 4, 3, 4, 4, 4, 4, 5, 4, 6], [13, 3, 13, 4, 12, 3, 12, 4, 12, 5, 12, 6], [8, 4, 8, 5, 7, 4, 7, 5], [10, 4, 10, 5, 5, 4, 5, 5], [0, 4, 0, 5, 0, 2, 0, 3, 7, 2, 7, 3], [6, 4, 6, 5, 1, 4, 1, 5, 1, 6, 1, 7], [2, 4, 2, 5, 2, 2, 2, 3, 5, 2, 5, 3], [4, 4, 4, 5, 3, 4, 3, 5, 3, 6, 3, 7], [5, 5, 5, 6, 6, 5, 6, 6], [13, 5, 13, 6, 14, 5, 14, 6], [1, 5, 1, 6, 0, 5, 0, 6, 0, 7, 0, 8], [7, 5, 7, 6, 7, 3, 7, 4, 6, 3, 6, 4], [9, 5, 9, 6, 8, 5, 8, 6, 8, 7, 8, 8], [15, 5, 15, 6, 15, 3, 15, 4, 14, 3, 14, 4], [4, 6, 4, 7, 11, 6, 11, 7], [6, 6, 6, 7, 9, 6, 9, 7], [12, 6, 12, 7, 12, 4, 12, 5, 11, 4, 11, 5], [14, 6, 14, 7, 14, 4, 14, 5, 9, 4, 9, 5], [1, 7, 1, 8, 2, 7, 2, 8], [9, 7, 9, 8, 10, 7, 10, 8], [3, 7, 3, 8, 3, 5, 3, 6, 2, 5, 2, 6], [11, 7, 11, 8, 11, 5, 11, 6, 10, 5, 10, 6], [10, 6, 10, 7, 13, 6, 13, 7, 13, 8, 13, 9], [8, 6, 8, 7, 15, 6, 15, 7, 15, 8, 15, 9], [5, 7, 5, 8, 4, 7, 4, 8, 4, 9, 4, 10], [13, 7, 13, 8, 12, 7, 12, 8, 12, 9, 12, 10], [8, 8, 8, 9, 7, 8, 7, 9], [10, 8, 10, 9, 5, 8, 5, 9], [0, 8, 0, 9, 0, 6, 0, 7, 7, 6, 7, 7], [6, 8, 6, 9, 1, 8, 1, 9, 1, 10, 1, 11], [2, 8, 2, 9, 2, 6, 2, 7, 5, 6, 5, 7], [4, 8, 4, 9, 3, 8, 3, 9, 3, 10, 3, 11], [5, 9, 5, 10, 6, 9, 6, 10], [13, 9, 13, 10, 14, 9, 14, 10], [1, 9, 1, 10, 0, 9, 0, 10, 0, 11, 0, 12], [7, 9, 7, 10, 7, 7, 7, 8, 6, 7, 6, 8], [9, 9, 9, 10, 8, 9, 8, 10, 8, 11, 8, 12], [15, 9, 15, 10, 15, 7, 15, 8, 14, 7, 14, 8], [4, 10, 4, 11, 11, 10, 11, 11], [6, 10, 6, 11, 9, 10, 9, 11], [12, 10, 12, 11, 12, 8, 12, 9, 11, 8, 11, 9], [10, 10, 10, 11, 13, 10, 13, 11, 13, 12, 13, 13], [14, 10, 14, 11, 14, 8, 14, 9, 9, 8, 9, 9], [8, 10, 8, 11, 15, 10, 15, 11, 15, 12, 15, 13], [1, 11, 1, 12, 2, 11, 2, 12], [9, 11, 9, 12, 10, 11, 10, 12], [3, 11, 3, 12, 3, 9, 3, 10, 2, 9, 2, 10], [5, 11, 5, 12, 4, 11, 4, 12, 4, 13, 4, 14], [1, 1, 11, 11, 12, 11, 9, 11, 10, 10, 9, 10, 10], [13, 11, 13, 12, 12, 11, 12, 12, 12, 13, 12, 14], [8, 12, 8, 13, 7, 12, 7, 13], [10, 12, 10, 13, 5, 12, 5, 13], [0, 12, 0, 13, 0, 10, 0, 11, 7, 10, 7, 11], [6, 12, 6, 13, 1, 12, 1, 13, 1, 14, 1, 15], [2, 12, 2, 13, 2, 10, 2, 11, 5, 10, 5, 11], [4, 12, 4, 13, 3, 12, 3, 13, 3, 14, 3, 15], [5, 13, 5, 14, 6, 13, 6, 14], [13, 13, 13, 14, 14, 13, 14, 14], [1, 13, 1, 14, 0, 13, 0, 14, 0, 15, 0, 16], [7, 13, 7, 14, 7, 11, 7, 12, 6, 11, 6, 12], [9, 13, 9, 14, 8, 13, 8, 14, 8, 15, 8, 16], [15, 13, 15, 14, 15, 11, 15, 12, 14, 11, 14, 12], [4, 14, 4, 15, 11, 14, 11, 15], [6, 14, 6, 15, 9, 14, 9, 15], [12, 14, 12, 15, 12, 12, 12, 13, 11, 12, 11, 13], [14, 14, 14, 15, 14, 12, 14, 13, 9, 12, 9, 13], [1, 15, 1, 16, 2, 15, 2, 16], [9, 15, 9, 16, 10, 15, 10, 16], [3, 15, 3, 16, 3, 13, 3, 14, 2, 13, 2, 14], [11, 15, 11, 16, 11, 13, 11, 14, 10, 13, 10, 14], [10, 14, 10, 15, 13, 14, 13, 15, 13, 16, 13, 17], [8, 14, 8, 15, 15, 14, 15, 15, 15, 16, 15, 17], [5, 15, 5, 16, 4, 15, 4, 16, 4, 17, 4, 18], [13, 15, 13, 16, 12, 15, 12, 16, 12, 17, 12, 18], [8, 16, 8, 17, 7, 16, 7, 17], [10, 16, 10, 17, 5, 16, 5, 17], [0, 16, 0, 17, 0, 14, 0, 15, 7, 14, 7, 15], [6, 16, 6, 17, 1, 16, 1, 17, 1, 18, 1, 19], [2, 16, 2, 17, 2, 14, 2, 15, 5, 14, 5, 15], [4, 16, 4, 17, 3, 16, 3, 17, 3, 18, 3, 19], [5, 17, 5, 18, 6, 17, 6, 18], [13, 17, 13, 18, 14, 17, 14, 18], [1, 17, 1, 18, 0, 17, 0, 18, 0, 19, 0, 20], [7, 17, 7, 18, 7, 15, 7, 16, 6, 15, 6, 16], [9, 17, 9, 18, 8, 17, 8, 18, 8, 19, 8, 20], [15, 17, 15, 18, 15, 15, 15, 16, 14, 15, 14, 16], [4, 18, 4, 19, 11, 18, 11, 19], [6, 18, 6, 19, 9, 18, 9, 19], [12, 18, 12, 19, 12, 16, 12, 17, 11, 16, 11, 17], [10, 18, 10, 19, 13, 18, 13, 19, 13, 20, 13, 21], [14, 18, 14, 19, 14, 16, 14, 17, 9, 16, 9, 17], [8, 18, 8, 19, 15, 18, 15, 19, 15, 20, 15, 21], [1, 19, 1, 20, 2, 19, 2, 20], [9, 19, 9, 20, 10, 19, 10, 20], [3, 19, 3, 20, 3, 17, 3, 18, 2, 17, 2, 18], [5, 19, 5, 20, 4, 19, 4, 20, 4, 21, 4, 22], [11, 19, 11, 20, 11, 17, 17, 10, 18], [10, 19, 10, 20, 13, 19, 13, 20, 12, 19, 12, 20, 22], [8, 20, 8, 21, 7, 20, 7, 21], [10, 20, 10, 21, 5, 20, 5, 21], [0, 20, 0, 21, 0, 18, 0, 19, 7, 18, 7, 19], [6, 20, 6, 21, 1, 20, 1, 21, 1, 22, 1, 23], [2, 20, 2, 21, 2, 18, 2, 19, 5, 18, 5, 19], [4, 20, 4, 21, 3, 20, 3, 21, 3, 22, 3, 23], [5, 21, 5, 22, 6, 21, 6, 22], [13, 21, 13, 22, 14, 21, 14, 22], [1, 21, 1, 22, 0, 21, 0, 22, 0, 23, 0, 24], [7, 21, 7, 22, 7, 19, 7, 20, 6, 19, 6, 20], [9, 21, 9, 22, 8, 21, 8, 22, 8, 23, 8, 24], [15, 21, 15, 22, 15, 19, 15, 20, 14, 19, 14, 20], [4, 22, 4, 23, 11, 22, 11, 23], [6, 22, 6, 23, 9, 22, 9, 23], [12, 22, 12, 23, 12, 20, 12, 21, 11, 20, 11, 21], [10, 22, 10, 23, 13, 22, 13, 23, 13, 24, 13, 25], [14, 22, 14, 23, 14, 20, 14, 21, 9, 20, 9, 21], [8, 22, 8, 23, 15, 22, 15, 23, 15, 24, 15, 25], [1, 23, 1, 24, 2, 23, 2, 24], [9, 23, 9, 24, 10, 23, 10, 24], [3, 23, 3, 24, 3, 21, 3, 22, 2, 21, 2, 22], [5, 23, 5, 24, 4, 23, 4, 24, 4, 25, 4, 26], [11, 23, 11, 24, 11, 21, 11, 22, 10, 21, 10, 22], [13, 23, 13, 24, 12, 23, 12, 24, 12, 25, 12, 26], [8, 24, 8, 25, 7, 24, 7, 25], [10, 24, 10, 25, 5, 24, 5, 25], [0, 24, 0, 25, 0, 22, 0, 23, 7, 22, 7, 23], [6, 24, 6, 25, 1, 24, 1, 25, 1, 26, 1, 27], [2, 24, 2, 25, 2, 22, 2, 23, 5, 22, 5, 23], [4, 24, 4, 25, 3, 24, 3, 25, 3, 26, 3, 27], [5, 25, 5, 26, 6, 25, 6, 26], [13, 25, 13, 26, 14, 25, 14, 26], [1, 25, 1, 26, 0, 25, 0, 26, 0, 27, 0, 28], [7, 25, 7, 26, 7, 23, 7, 24, 6, 23, 6, 24], [9, 25, 9, 26, 8, 25, 8, 26, 8, 27, 8, 28], [15, 25, 15, 26, 15, 23, 15, 24, 14, 23, 14, 24], [4, 26, 4, 27, 11, 26, 11, 27], [6, 26, 6, 27, 9, 26, 9, 27], [12, 26, 12, 27, 12, 24, 12, 25, 11, 24, 11, 25], [10, 26, 10, 27, 13, 26, 13, 27, 13, 28, 13, 29], [14, 26, 14, 27, 14, 24, 14, 25, 9, 24, 9, 25], [8, 26, 8, 27, 15, 26, 15, 27, 15, 28, 15, 29], [1, 27, 1, 28, 2, 27, 2, 28], [9, 27, 9, 28, 10, 27, 10, 28], [3, 27, 3, 28, 3, 25, 3, 26, 2, 25, 2, 26], [5, 27, 5, 28, 4, 27, 4, 28, 4, 29, 4, 30], [11, 27, 11, 28, 11, 25, 11, 26, 10, 25, 10, 26], [13, 27, 13, 28, 12, 27, 12, 28, 12, 29, 12, 30], [8, 28, 8, 29, 7, 28, 7, 29], [10, 28, 10, 29, 5, 28, 5, 29], [0, 28, 0, 29, 0, 26, 0, 27, 7, 26, 7, 27], [6, 28, 6, 29, 1, 28, 1, 29, 1, 30, 1, 31], [2, 28, 2, 29, 2, 26, 2, 27, 5, 26, 5, 27], [4, 28, 4, 29, 3, 28, 3, 29, 3, 30, 3, 31], [5, 29, 5, 30, 6, 29, 6, 30], [13, 29, 13, 30, 14, 29, 14, 30], [1, 29, 1, 30, 0, 29, 0, 30, 0, 31, 0, 32], [7, 29, 7, 30, 7, 27, 7, 28, 6, 27, 6, 28], [9, 29, 9, 30, 8, 29, 8, 30, 8, 31, 8, 32], [15, 29, 15, 30, 15, 27, 15, 28, 14, 27, 14, 28], [4, 30, 4, 31, 11, 30, 11, 31], [6, 30, 6, 31, 9, 30, 9, 31], [12, 30, 12, 31, 12, 28, 12, 29, 11, 28, 11, 29], [14, 30, 14, 31, 14, 28, 14, 29, 9, 28, 9, 29], [1, 31, 1, 32, 2, 31, 2, 32], [9, 31, 9, 32, 10, 31, 10, 32], [3, 31, 3, 32, 3, 29, 3, 30, 2, 29, 2, 30], [11, 31, 11, 32, 11, 29, 11, 30, 10, 29, 10, 30], [10, 30, 10, 31, 13, 30, 13, 31, 13, 32, 13, 33], [8, 30, 8, 31, 15, 30, 15, 31, 15, 32, 15, 33], [5, 31, 5, 32, 4, 31, 4, 32, 4, 33, 4, 34], [13, 31, 13, 32, 12, 31, 12, 32, 12, 33, 12, 34], [8, 32, 8, 33, 7, 32, 7, 33], [10, 32, 10, 33, 5, 32, 5, 33], [0, 32, 0, 33, 0, 30, 0, 31, 7, 30, 7, 31], [6, 32, 6, 33, 1, 32, 1, 33, 1, 34, 1, 35], [2, 32, 2, 33, 2, 30, 2, 31, 5, 30, 5, 31], [4, 32, 4, 33, 3, 32, 3, 33, 3, 34, 3, 35], [5, 33, 5, 34, 6, 33, 6, 34], [13, 33, 13, 34, 14, 33, 14, 34], [1, 33, 1, 34, 0, 33, 0, 34, 0, 35, 0, 36], [7, 33, 7, 34, 7, 31, 7, 32, 6, 31, 6, 32], [9, 33, 9, 34, 8, 33, 8, 34, 8, 35, 8, 36], [15, 33, 15, 34, 15, 31, 15, 32, 14, 31, 14, 32], [4, 34, 4, 35, 11, 34, 11, 35], [6, 34, 6, 35, 9, 34, 9, 35], [12, 34, 12, 35, 12, 32, 12, 33, 11, 32, 11, 33], [10, 34, 10, 35, 13, 34, 13, 35, 13, 36, 13, 37], [14, 34, 14, 35, 14, 32, 14, 33, 9, 32, 9, 33], [8, 34, 8, 35, 15, 34, 15, 35, 15, 36, 15, 37], [1, 35, 1, 36, 2, 35, 2, 36], [9, 35, 9, 36, 10, 35, 10, 36], [3, 35, 3, 36, 3, 33, 3, 34, 2, 33, 2, 34], [5, 35, 5, 36, 4, 35, 4, 36, 4, 37, 4, 38], [1 1, 35, 11, 36, 11, 33, 11, 34, 10, 33, 10, 34], [13, 35, 13, 36, 12, 35, 12, 36, 12, 37, 12, 38], [8, 36, 8, 37, 7, 36, 7, 37], [10, 36, 10, 37, 5, 36, 5, 37], [0, 36, 0, 37, 0, 34, 0, 35, 7, 34, 7, 35], [6, 36, 6, 37, 1, 36, 1, 37, 1, 38, 1, 39], [2, 36, 2, 37, 2, 34, 2, 35, 5, 34, 5, 35], [4, 36, 4, 37, 3, 36, 3, 37, 3, 38, 3, 39], [5, 37, 5, 38, 6, 37, 6, 38], [13, 37, 13, 38, 14, 37, 14, 38], [1, 37, 1, 38, 0, 37, 0, 38, 0, 39, 0, 40], [7, 37, 7, 38, 7, 35, 7, 36, 6, 35, 6, 36], [9, 37, 9, 38, 8, 37, 8, 38, 8, 39, 8, 40], [15, 37, 15, 38, 15, 35, 15, 36, 14, 35, 14, 36], [4, 38, 4, 39, 11, 38, 11, 39], [6, 38, 6, 39, 9, 38, 9, 39], [12, 38, 12, 39, 12, 36, 12, 37, 11, 36, 11, 37], [10, 38, 10, 39, 13, 38, 13, 39, 13, 40, 13, 41], [14, 38, 14, 39, 14, 36, 14, 37, 9, 36, 9, 37], [8, 38, 8, 39, 15, 38, 15, 39, 15, 40, 15, 41], [1, 39, 1, 40, 2, 39, 2, 40], [9, 39, 9, 40, 10, 39, 10, 40], [3, 39, 3, 40, 3, 37, 3, 38, 2, 37, 2, 38], [5, 39, 5, 40, 4, 39, 4, 40, 4, 41, 4, 42], [1 1, 39, 11, 40, 11, 37, 11, 38, 10, 37, 10, 38], [13, 39, 13, 40, 12, 39, 12, 40, 12, 41, 12, 42], [8, 40, 8, 41, 7, 40, 7, 41], [10, 40, 10, 41, 5, 40, 5, 41], [0, 40, 0, 41, 0, 38, 0, 39, 7, 38, 7, 39], [6, 40, 6, 41, 1, 40, 1, 41, 1, 42, 1, 43], [2, 40, 2, 41, 2, 38, 2, 39, 5, 38, 5, 39], [4, 40, 4, 41, 3,

TABLE 19A-continued 40, 3, 41, 3, 42, 3, 43], [5, 41, 5, 42, 6, 41, 6, 42], [13, 41, 13, 42, 14, 41, 14, 42], [1, 41, 1, 42, 0, 41, 0, 42, 0, 43, 0, 44], [7, 41, 7, 42, 7, 39, 7, 40, 6, 39, 6, 40], [9, 41, 9, 42, 8, 41, 8, 42, 8, 43, 8, 44], [15, 41, 15, 42, 15, 39, 15, 40, 14, 39, 14, 40], [4, 42, 4, 43, 11, 42, 11, 43], [6, 42, 6, 43, 9, 42, 9, 43], [12, 42, 12, 43, 12, 40, 12, 41, 11, 40, 11, 41], [10, 42, 10, 43, 13, 42, 13, 43, 13, 44, 13, 45], [14, 42, 14, 43, 14, 40, 14, 41, 9, 40, 9, 41], [8, 42, 8, 43, 15, 42, 15, 43, 15, 44, 15, 45], [1, 43, 1, 44, 2, 43, 2, 44], [9, 43, 9, 44, 10, 43, 10, 44], [3, 43, 3, 44, 3, 41, 3, 42, 2, 41, 2, 42], [5, 43, 5, 44, 4, 43, 4, 44, 4, 45, 4, 46], [11, 43, 11, 44, 11, 41, 11, 42, 10, 41, 10, 42], [13, 43, 13, 44, 12, 43, 12, 44, 12, 45, 12, 46], [8, 44, 8, 45, 7, 44, 7, 45], [10, 44, 10, 45, 5, 44, 5, 45], [0, 44, 0, 45, 0, 42, 0, 43, 7, 42, 7, 43], [6, 44, 6, 45, 1, 44, 1, 45, 1, 46, 1, 47], [2, 44, 2, 45, 2, 42, 2, 43, 5, 42, 5, 43], [4, 44, 4, 45, 3, 44, 3, 45, 3, 46, 3, 47], [5, 45, 5, 46, 6, 45, 6, 46], [13, 45, 13, 46, 14, 45, 14, 46], [1, 45, 1, 46, 0, 45, 0, 46, 0, 47, 0, 48], [7, 45, 7, 46, 7, 43, 7, 44, 6, 43, 6, 44], [9, 45, 9, 46, 8, 45, 8, 46, 8, 47, 8, 48], [15, 45, 15, 46, 15, 43, 15, 44, 14, 43, 14, 44], [4, 46, 4, 47, 11, 46, 11, 47], [6, 46, 6, 47, 9, 46, 9, 47], [12, 46, 12, 47, 12, 44, 12, 45, 11, 44, 11, 45], [10, 46, 10, 47, 13, 46, 13, 47, 13, 48, 13, 49], [14, 46, 14, 47, 14, 44, 14, 45, 9, 44, 9, 45], [8, 46, 8, 47, 15, 46, 15, 47, 15, 48, 15, 49], [1, 47, 1, 48, 2, 47, 2, 48], [9, 47, 9, 48, 10, 47, 10, 48], [3, 47, 3, 48, 3, 45, 3, 46, 2, 45, 2, 46], [5, 47, 5, 48, 4, 47, 4, 48, 4, 49, 4, 50], [1 1, 47, 11, 48, 11, 45, 11, 46, 10, 45, 10, 46], [13, 47, 13, 48, 12, 47, 12, 48, 12, 49, 12, 50], [8, 48, 8, 49, 7, 48, 7, 49], [10, 48, 10, 49, 5, 48, 5, 49], [0, 48, 0, 49, 0, 46, 0, 47, 7, 46, 7, 47], [6, 48, 6, 49, 1, 48, 1, 49, 1, 50, 1, 51], [2, 48, 2, 49, 2, 46, 2, 47, 5, 46, 5, 47], [4, 48, 4, 49, 3, 48, 3, 49, 3, 50, 3, 51], [5, 49, 5, 50, 6, 49, 6, 50], [13, 49, 13, 50, 14, 49, 14, 50], [1, 49, 1, 50, 0, 49, 0, 50, 0, 51, 0, 52], [7, 49, 7, 50, 7, 47, 7, 48, 6, 47, 6, 48], [9, 49, 9, 50, 8, 49, 8, 50, 8, 51, 8, 52], [15, 49, 15, 50, 15, 47, 15, 48, 14, 47, 14, 48], [4, 50, 4, 51, 11, 50, 11, 51], [6, 50, 6, 51, 9, 50, 9, 51], [12, 50, 12, 51, 12, 48, 12, 49, 11, 48, 11, 49], [10, 50, 10, 51, 13, 50, 13, 51, 13, 52, 13, 53], [14, 50, 14, 51, 14, 48, 14, 49, 9, 48, 9, 49], [8, 50, 8, 51, 15, 50, 15, 51, 15, 52, 15, 53], [1, 51, 1, 52, 2, 51, 2, 52], [9, 51, 9, 52, 10, 51, 10, 52], [3, 51, 3, 52, 3, 49, 3, 50, 2, 49, 2, 50], [5, 51, 5, 52, 4, 51, 4, 52, 4, 53, 4, 54], [11, 51, 11, 52, 11, 49, 11, 50, 10, 49, 10, 50], [13, 51, 13, 52, 12, 51, 12, 52, 12, 53, 12, 54], [8, 52, 8, 53, 7, 52, 7, 53], [10, 52, 10, 53, 5, 52, 5, 53], [0, 52, 0, 53, 0, 50, 0, 51, 7, 50, 7, 51], [6, 52, 6, 53, 1, 52, 1, 53, 1, 54, 1, 55], [2, 52, 2, 53, 2, 50, 2, 51, 5, 50, 5, 51], [4, 52, 4, 53, 3, 52, 3, 53, 3, 54, 3, 55], [5, 53, 5, 54, 6, 53, 6, 54], [13, 53, 13, 54, 14, 53, 14, 54], [1, 53, 1, 54, 0, 53, 0, 54, 0, 55, 0, 56], [7, 53, 7, 54, 7, 51, 7, 52, 6, 51, 6, 52], [9, 53, 9, 54, 8, 53, 8, 54, 8, 55, 8, 56], [15, 53, 15, 54, 15, 51, 15, 52, 14, 51, 14, 52], [4, 54, 4, 55, 11, 54, 11, 55], [6, 54, 6, 55, 9, 54, 9, 55], [12, 54, 12, 55, 12, 52, 12, 53, 11, 52, 11, 53], [10, 54, 10, 55, 13, 54, 13, 55, 13, 56, 13, 57], [14, 54, 14, 55, 14, 52, 14, 53, 9, 52, 9, 53], [8, 54, 8, 55, 15, 54, 15, 55, 15, 56, 15, 57], [1, 55, 1, 56, 2, 55, 2, 56], [9, 55, 9, 56, 10, 55, 10, 56], [3, 55, 3, 56, 3, 53, 3, 54, 2, 53, 2, 54], [5, 55, 5, 56, 4, 55, 4, 56, 4, 57, 4, 58], [11, 55, 11, 56, 11, 53, 11, 54, 10, 53, 10, 54], [13, 55, 13, 56, 12, 55, 12, 56, 12, 57, 12, 58], [8, 56, 8, 57, 7, 56, 7, 57], [10, 56, 10, 57, 5, 56, 5, 57], [0, 56, 0, 57, 0, 54, 0, 55, 7, 54, 7, 55], [6, 56, 6, 57, 1, 56, 1, 57, 1, 58, 1, 59], [2, 56, 2, 57, 2, 54, 2, 55, 5, 54, 5, 55], [4, 56, 4, 57, 3, 56, 3, 57, 3, 58, 3, 59], [5, 57, 5, 58, 6, 57, 6, 58], [13, 57, 13, 58, 14, 57, 14, 58], [1, 57, 1, 58, 0, 57, 0, 58, 0, 59, 0, 60], [7, 57, 7, 58, 7, 55, 7, 56, 6, 55, 6, 56], [9, 57, 9, 58, 8, 57, 8, 58, 8, 59, 8, 60], [15, 57, 15, 58, 15, 55, 15, 56, 14, 55, 14, 56], [4, 58,4, 59, 11, 58, 11, 59], [6, 58, 6, 59, 9, 58, 9, 59], [12, 58, 12, 59, 12, 56, 12, 57, 11, 56, 11, 57], [10, 58, 10, 59, 13, 58, 13, 59, 13, 60, 13, 61], [14, 58, 14, 59, 14, 56, 14, 57, 9, 56, 9, 57], [8, 58, 8, 59, 15, 58, 15, 59, 15, 60, 15, 61], [1, 59, 1, 60, 2, 59, 2, 60], [9, 59, 9, 60, 10, 59, 10, 60], [3, 59, 3, 60, 3, 57, 3, 58, 2, 57, 2, 58], [5, 59, 5, 60, 4, 59, 4, 60, 4, 61, 4, 62], [11, 59, 11, 60, 11, 57, 11, 58, 10, 57, 10, 58], [13, 59, 13, 60, 12, 59, 12, 60, 12, 61, 12, 62], [8, 60, 8, 61, 7, 60, 7, 61], [10, 60, 10, 61, 5, 60, 5, 61], [0, 60, 0, 61, 0, 58, 0, 59, 7, 58, 7, 59], [6, 60, 6, 61, 1, 60, 1, 61, 1, 62, 1, 63], [2, 60, 2, 61, 2, 58, 2, 59, 5, 58, 5, 59], [4, 60, 4, 61, 3, 60, 3, 61, 3, 62, 3, 63], [5, 61, 5, 62, 6, 61, 6, 62], [13, 61, 13, 62, 14, 61, 14, 62], [1, 61, 1, 62, 0, 61, 0, 62, 0, 63, 0, 64], [7, 61, 7, 62, 7, 59, 7, 60, 6, 59, 6, 60], [9, 61, 9, 62, 8, 61, 8, 62, 8, 63, 8, 64], [15, 61, 15, 62, 15, 59, 15, 60, 14, 59, 14, 60], [4, 62, 4, 63, 11, 62, 11, 63], [6, 62, 6, 63, 9, 62, 9, 63], [12, 62, 12, 63, 12, 60, 12, 61, 11, 60, 11, 61], [14, 62, 14, 63, 14, 60, 14, 61, 9, 60, 9, 61], [1, 63, 1, 64, 2, 63, 2, 64], [9, 63, 9, 64, 10, 63, 10, 64], [3, 63, 3, 64, 3, 61, 3, 62, 2, 61, 2, 62], [11, 63, 11, 64, 11, 61, 11, 62, 10, 61, 10, 62].

TABLE 19B

[10, 62, 10, 63, 13, 62, 13, 63, 13, 64, 0, 0], [8, 62, 8, 63, 15, 62, 15, 63, 15, 64, 0, 0], [5, 63, 5, 64, 4, 63, 4, 64], [7, 63, 7, 64, 6, 63, 6, 64], [13, 63, 13, 64, 12, 63, 12, 64], [15, 63, 15, 64, 14, 63, 14, 64], [4, 64, 0, 0, 3, 64, 0, 0], [6, 64, 0, 0, 1, 64, 0, 0], [8, 64, 0, 0, 7, 64, 0, 0], [10, 64, 0, 0, 5, 64, 0, 0], [12, 64, 0, 0, 11, 64, 0, 0], [14, 64, 0, 0, 9, 64, 0, 0], [0, 64, 0, 0, 0, 62, 0, 63, 7, 62, 7, 63], [2, 64, 0, 0, 2, 62, 2, 63, 5, 62, 5, 63]

The core oligonucleotide sequences used to produce 6H×6H×32B nucleic acid structures of the invention are designated SEQ ID NOs. 3703-3762, and the corresponding voxel coordinates are shown respectively in Table 20A. The end oligonucleotide sequences used to produce 6H×6H×32B nucleic acid structures of the invention are designated SEQ ID NOs. 4183-4209, and the corresponding voxel coordinates are shown respectively in Table 20B. (See also Appendix, Table 9 of U.S. provisional application No. 61/675,309, filed Jul. 24, 2012, incorporated by reference herein.)

TABLE 20A

[0, 0, 0, 1, 0, 0, 0, 0], [0, 0, 2, 1, 0, 0, 0, 0], [0, 0, 4, 1, 0, 0, 0, 0], [0, 0, 31, 1, 0, 0, 0, 0], [0, 0, 33, 1, 0, 0, 0, 0], [0, 0, 35, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 10, 1, 0, 0, 1, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [1 1, 1, 11, 2, 0, 0, 0, 0], [18, 1, 18, 2, 0, 0, 0, 0], [23, 1, 23, 2, 0, 0, 0, 01, [30, 1, 30, 2, 0, 0, 0, 0], [35, 1, 35, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2, 34, 1, 34, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [30, 2, 30, 3, 0, 0, 30, 1, 0, 0, 29, 1], [32, 2, 32, 3, 0, 0, 32, 1, 0, 0, 27, 1], [34, 2, 34, 3, 0, 0, 34, 1, 0, 0, 25, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2].

TABLE 20B

[28, 2, 28, 3, 31, 2, 31, 3, 31, 4, 0, 0], [26, 2, 26, 3, 33, 2, 33, 3, 33, 4, 0, 0], [24, 2, 24, 3, 35, 2, 35, 3, 35, 4, 0, 0], [7, 3, 7, 4, 6, 3, 6, 4], [11, 3, 11, 4, 10, 3, 10, 4], [19, 3, 19, 4, 18, 3, 18, 4], [23, 3, 23, 4, 22, 3, 22, 4], [31, 3, 31, 4, 30, 3, 30, 4], [35, 3, 35, 4, 34, 3, 34, 4], [6, 4, 0, 0, 5, 4, 0, 0], [8, 4, 0, 0, 3, 4, 0, 0], [10, 4, 0, 0, 1, 4, 0, 0], [12, 4, 0, 0, 11, 4, 0, 0], [14, 4, 0, 0, 9, 4, 0, 0], [16, 4, 0, 0, 7, 4, 0, 0], [18, 4, 0, 0, 17, 4, 0, 0], [20, 4, 0, 0, 15, 4, 0, 0], [22, 4, 0, 0, 13, 4, 0, 0], [24, 4, 0, 0, 23, 4, 0, 0], [26, 4, 0, 0, 21, 4, 0, 0],

TABLE 20B-continued

[28, 4, 0, 0, 19, 4, 0, 0], [30, 4, 0, 0, 29, 4, 0, 0], [32, 4, 0, 0, 27, 4, 0, 0], [34, 4, 0, 0, 25, 4, 0, 0], [0, 4, 0, 0, 0, 2, 0, 3, 11, 2, 11, 3], [2, 4, 0, 0, 2, 2, 2, 3, 9, 2, 9, 3], [4, 4, 0, 0, 4, 2, 4, 3, 7, 2, 7, 3]

The core oligonucleotide sequences used to produce 6H×6H×64B nucleic acid structures of the invention are designated SEQ ID NOs. 3703-3822, and the corresponding voxel coordinates are shown respectively in Table 21A. The end oligonucleotide sequences used to produce 6H×6H×64B nucleic acid structures of the invention are designated SEQ ID NOs. 4210-4236, and the corresponding voxel coordinates are shown respectively in Table 21B. (See also Appendix, Table 9 of U.S. provisional application No. 61/675,309, filed Jul. 24, 2012, incorporated by reference herein.)

TABLE 21A

[0, 0, 0, 1, 0, 0, 0, 0], [0, 0, 2, 1, 0, 0, 0, 0], [0, 0, 4, 1, 0, 0, 0, 0], [0, 0, 31, 1, 0, 0, 0, 0], [0, 0, 33, 1, 0, 0, 0, 0], [0, 0, 35, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 10, 1, 0, 0, 1, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [1 1, 1, 11, 2, 0, 0, 0, 0], [18, 1, 18, 2, 0, 0, 0, 0], [23, 1, 23, 2, 0, 0, 0, 0], [30, 1, 30, 2, 0, 0, 0, 0], [35, 1, 35, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2, 34, 1, 34, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [30, 2, 30, 3, 0, 0, 30, 1, 0, 0, 29, 1], [32, 2, 32, 3, 0, 0, 32, 1, 0, 0, 27, 1], [34, 2, 34, 3, 0, 0, 34, 1, 0, 0, 25, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2], [28, 2, 28, 3, 31, 2, 31, 3, 31, 4, 31, 5], [26, 2, 26, 3, 33, 2, 33, 3, 33, 4, 33, 5], [24, 2, 24, 3, 35, 2, 35, 3, 35, 4, 35, 5], [7, 3, 7, 4, 6, 3, 6, 4, 6, 5, 6, 6], [19, 3, 19, 4, 18, 3, 18, 4, 18, 5, 18, 6], [31, 3, 31, 4, 30, 3, 30, 4, 30, 5, 30, 6], [12, 4, 12, 5, 11, 4, 11, 5], [14, 4, 14, 5, 9, 4, 9, 5], [16, 4, 16, 5, 7, 4, 7, 5], [18, 4, 18, 5, 17, 4, 17, 5], [20, 4, 20, 5, 15, 4, 15, 5], [22, 4, 22, 5, 13, 4, 13, 5], [24, 4, 24, 5, 23, 4, 23, 5], [26, 4, 26, 5, 21, 4, 21, 5], [28, 4, 28, 5, 19, 4, 19, 5], [0, 4, 0, 5, 0, 2, 0, 3, 11, 2, 11, 3], [10, 4, 10, 5, 1, 4, 1, 5, 1, 6, 1, 7], [2, 4, 2, 5, 2, 2, 2, 3, 9, 2, 9, 3], [8, 4, 8, 5, 3, 4, 3, 5, 3, 6, 3, 7], [4, 4, 4, 5, 4, 2, 4, 3, 7, 2, 7, 3], [6, 4, 6, 5, 5, 4, 5, 5, 5, 6, 5, 7], [3, 5, 3, 6, 2, 5, 2, 6], [7, 5, 7, 6, 8, 5, 8, 6], [9, 5, 9, 6, 10, 5, 10, 6], [15, 5, 15, 6, 14, 5, 14, 6], [19, 5, 19, 6, 20, 5, 20, 6], [21, 5, 21, 6, 22, 5, 22, 6], [27, 5, 27, 6, 26, 5, 26, 6], [31, 5, 31, 6, 32, 5, 32, 6], [33, 5, 33, 6, 34, 5, 34, 6], [1, 5, 1, 6, 0, 5, 0, 6, 0, 7, 0, 8], [11, 5, 11, 6, 11, 3, 11, 4, 10, 3, 10, 4], [13, 5, 13, 6, 12, 5, 12, 6, 12, 7, 12, 8], [23, 5, 23, 6, 23, 3, 23, 4, 22, 3, 22, 4], [25, 5, 25, 6, 24, 5, 24, 6, 24, 7, 24, 8], [35, 5, 35, 6, 35, 3, 35, 4, 34, 3, 34, 4], [6, 6, 6, 7, 17, 6, 17, 7], [8, 6, 8, 7, 15, 6, 15, 7], [12, 6, 12, 7, 23, 6, 23, 7], [14, 6, 14, 7, 21, 6, 21, 7], [16, 6, 16, 7, 19, 6, 19, 7], [18, 6, 18, 7, 29, 6, 29, 7], [20, 6, 20, 7, 27, 6, 27, 7], [22, 6, 22, 7, 25, 6, 25, 7], [30, 6, 30, 7, 30, 4, 30, 5, 29, 4, 29, 5], [32, 6, 32, 7, 32, 4, 32, 5, 27, 4, 27, 5], [34, 6, 34, 7, 34, 4, 34, 5, 25, 4, 25, 5], [1, 7, 1, 8, 2, 7, 2, 8], [3, 7, 3, 8, 4, 7, 4, 8], [9, 7, 9, 8, 8, 7, 8, 8], [13, 7, 13, 8, 14, 7, 14, 8], [15, 7, 15, 8, 16, 7, 16, 8], [21, 7, 21, 8, 20, 7, 20, 8], [25, 7, 25, 8, 26, 7, 26, 8], [27, 7, 27, 8, 28, 7, 28, 8], [33, 7, 33, 8, 32, 7, 32, 8], [5, 7, 5, 8, 5, 5, 5, 6, 4, 5, 4, 6], [17, 7, 17, 8, 17, 5, 17, 6, 16, 5, 16, 6], [29, 7, 29, 8, 29, 5, 29, 6, 28, 5, 28, 6].

TABLE 21B

[28, 6, 28, 7, 31, 6, 31, 7, 31, 8, 0, 0],
[26, 6, 26, 7, 33, 6, 33, 7, 33, 8, 0, 0],
[24, 6, 24, 7, 35, 6, 35, 7, 35, 8, 0, 0], [7, 7, 7, 8, 6, 7, 6, 8],
[11, 7, 11, 8, 10, 7, 10, 8], [19, 7, 19, 8, 18, 7, 18, 8], [23, 7, 23, 8, 22, 7, 22, 8], [31, 7, 31, 8, 30, 7, 30, 8], [35, 7, 35, 8, 34, 7, 34, 8],
[6, 8, 0, 0, 5, 8, 0, 0], [8, 8, 0, 0, 3, 8, 0, 0], [10, 8, 0, 0, 1, 8, 0, 0],
[12, 8, 0, 0, 11, 8, 0, 0], [14, 8, 0, 0, 9, 8, 0, 0], [16, 8, 0, 0, 7, 8, 0, 0], [18, 8, 0, 0, 17, 8, 0, 0], [20, 8, 0, 0, 15, 8, 0, 0],
[22, 8, 0, 0, 13, 8, 0, 0],
[24, 8, 0, 0, 23, 8, 0, 0], [26, 8, 0, 0, 21, 8, 0, 0], [28, 8, 0, 0, 19, 8, 0, 0], [30, 8, 0, 0, 29, 8, 0, 0], [32, 8, 0, 0, 27, 8, 0, 0],
[34, 8, 0, 0, 25, 8, 0, 0],
[0, 8, 0, 0, 0, 6, 0, 7, 11, 6, 11, 7], [2, 8, 0, 0, 2, 6, 2, 7, 9, 6, 9, 7], [4, 8, 0, 0, 4, 6, 4, 7, 7, 6, 7, 7]

The core oligonucleotide sequences used to produce 6H×6H×128B nucleic acid structures of the invention are designated SEQ ID NOs. 3703-3942, and the corresponding voxel coordinates are shown respectively in Table 22A. The end oligonucleotide sequences used to produce 6H×6H×128B nucleic acid structures of the invention are designated SEQ ID NOs. 4237-4263, and the corresponding voxel coordinates are shown respectively in Table 22B. (See also Appendix, Table 9 of U.S. provisional application No. 61/675,309, filed Jul. 24, 2012, incorporated by reference herein.)

TABLE 22A

[0, 0, 0, 1, 0, 0, 0, 0], [0, 0, 2, 1, 0, 0, 0, 0], [0, 0, 4, 1, 0, 0, 0, 0], [0, 0, 31, 1, 0, 0, 0, 0], [0, 0, 33, 1, 0, 0, 0, 0], [0, 0, 35, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 10, 1, 0, 0, 1, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [11, 1, 11, 2, 0, 0, 0, 0], [18, 1, 18, 2, 0, 0, 0, 0], [23, 1, 23, 2, 0, 0, 0, 0], [30, 1, 30, 2, 0, 0, 0, 0], [35, 1, 35, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2, 34, 1, 34, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [30, 2, 30, 3, 0, 0, 30, 1, 0, 0, 29, 1], [32, 2,

TABLE 22A-continued 32, 3, 0, 0, 32, 1, 0, 0, 27, 1], [34, 2, 34, 3, 0, 0, 34, 1, 0, 0, 25, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2], [28, 2, 28, 3, 31, 2, 31, 3, 31, 4, 31, 5], [26, 2, 26, 3, 33, 2, 33, 3, 33, 4, 33, 5], [24, 2, 24, 3, 35, 2, 35, 3, 35, 4, 35, 5], [7, 3, 7, 4, 6, 3, 6, 4, 6, 5, 6, 6], [19, 3, 19, 4, 18, 3, 18, 4, 18, 5, 18, 6], [31, 3, 31, 4, 30, 3, 30, 4, 30, 5, 30, 6], [12, 4, 12, 5, 11, 4, 11, 5], [14, 4, 14, 5, 9, 4, 9, 5], [16, 4, 16, 5, 7, 4, 7, 5], [18, 4, 18, 5, 17, 4, 17, 5], [20, 4, 20, 5, 15, 4, 15, 5], [22, 4, 22, 5, 13, 4, 13, 5], [24, 4, 24, 5, 23, 4, 23, 5], [26, 4, 26, 5, 21, 4, 21, 5], [28, 4, 28, 5, 19, 4, 19, 5], [0, 4, 0, 5, 0, 2, 0, 3, 11, 2, 11, 3], [10, 4, 10, 5, 1, 4, 1, 5, 1, 6, 1, 7], [2, 4, 2, 5, 2, 2, 2, 3, 9, 2, 9, 3], [8, 4, 8, 5, 3, 4, 3, 5, 3, 6, 3, 7], [4, 4, 4, 5, 4, 2, 4, 3, 7, 2, 7, 3], [6, 4, 6, 5, 5, 4, 5, 5, 5, 6, 5, 7], [3, 5, 3, 6, 2, 5, 2, 6], [7, 5, 7, 6, 8, 5, 8, 6], [9, 5, 9, 6, 10, 5, 10, 6], [15, 5, 15, 6, 14, 5, 14, 6], [19, 5, 19, 6, 20, 5, 20, 6], [21, 5, 21, 6, 22, 5, 22, 6], [27, 5, 27, 6, 26, 5, 26, 6], [31, 5, 31, 6, 32, 5, 32, 6], [33, 5, 33, 6, 34, 5, 34, 6], [1, 5, 1, 6, 0, 5, 0, 6, 0, 7, 0, 8], [11, 5, 11, 6, 11, 3, 11, 4, 10, 3, 10, 4], [13, 5, 13, 6, 12, 5, 12, 6, 12, 7, 12, 8], [23, 5, 23, 6, 23, 3, 23, 4, 22, 3, 22, 4], [25, 5, 25, 6, 24, 5, 24, 6, 24, 7, 24, 8], [35, 5, 35, 6, 35, 3, 35, 4, 34, 3, 34, 4], [6, 6, 6, 7, 17, 6, 17, 7], [8, 6, 8, 7, 15, 6, 15, 7], [10, 6, 10, 7, 13, 6, 13, 7], [12, 6, 12, 7, 23, 6, 23, 7], [14, 6, 14, 7, 21, 6, 21, 7], [16, 6, 16, 7, 19, 6, 19, 7], [18, 6, 18, 7, 29, 6, 29, 7], [20, 6, 20, 7, 27, 6, 27, 7], [22, 6, 22, 7, 25, 6, 25, 7], [30, 6, 30, 7, 30, 4, 30, 5, 29, 4, 29, 5], [32, 6, 32, 7, 32, 4, 32, 5, 27, 4, 27, 5], [34, 6, 34, 7, 34, 4, 34, 5, 25, 4, 25, 5], [1, 7, 1, 8, 2, 7, 2, 8], [3, 7, 3, 8, 4, 7, 4, 8], [9, 7, 9, 8, 8, 7, 8, 8], [13, 7, 13, 8, 14, 7, 14, 8], [15, 7, 15, 8, 16, 7, 16, 8], [21, 7, 21, 8, 20, 7, 20, 8], [25, 7, 25, 8, 26, 7, 26, 8], [27, 7, 27, 8, 28, 7, 28, 8], [33, 7, 33, 8, 32, 7, 32, 8], [5, 7, 5, 8, 5, 5, 5, 6, 4, 5, 4, 6], [17, 7, 17, 8, 17, 5, 17, 6, 16, 5, 16, 6], [29, 7, 29, 8, 29, 5, 29, 6, 28, 5, 28, 6], [28, 6, 28, 7, 31, 6, 31, 7, 31, 8, 31, 9], [26, 6, 26, 7, 33, 6, 33, 7, 33, 8, 33, 9], [24, 6, 24, 7, 35, 6, 35, 7, 35, 8, 35, 9], [7, 7, 7, 8, 6, 7, 6, 8, 6, 9, 6, 10], [19, 7, 19, 8, 18, 7, 18, 8, 18, 9, 18, 10], [31, 7, 31, 8, 30, 7, 30, 8, 30, 9, 30, 10], [12, 8, 12, 9, 11, 8, 11, 9], [14, 8, 14, 9, 9, 8, 9, 9], [16, 8, 16, 9, 7, 8, 7, 9], [18, 8, 18, 9, 17, 8, 17, 9], [20, 8, 20, 9, 15, 8, 15, 9], [22, 8, 22, 9, 13, 8, 13, 9], [24, 8, 24, 9, 23, 8, 23, 9], [26, 8, 26, 9, 21, 8, 21, 9], [28, 8, 28, 9, 19, 8, 19, 9], [0, 8, 0, 9, 0, 6, 0, 7, 11, 6, 11, 7], [10, 8, 10, 9, 1, 8, 1, 9, 1, 10, 1, 11], [2, 8, 2, 9, 2, 6, 2, 7, 9, 6, 9, 7], [8, 8, 8, 9, 3, 8, 3, 9, 3, 10, 3, 11], [4, 8, 4, 9, 4, 6, 4, 7, 7, 6, 7, 7], [6, 8, 6, 9, 5, 8, 5, 9, 5, 10, 5, 11], [3, 9, 3, 10, 2, 9, 2, 10], [7, 9, 7, 10, 8, 9, 8, 10], [9, 9, 9, 10, 10, 9, 10, 10], [15, 9, 15, 10, 14, 9, 14, 10], [19, 9, 19, 10, 20, 9, 20, 10], [21, 9, 21, 10, 22, 9, 22, 10], [27, 9, 27, 10, 26, 9, 26, 10], [31, 9, 31, 10, 32, 9, 32, 10], [33, 9, 33, 10, 34, 9, 34, 10], [1, 9, 1, 10, 0, 9, 0, 10, 0, 11, 0, 12], [11, 9, 11, 10, 11, 7, 11, 8, 10, 7, 10, 8], [13, 9, 13, 10, 12, 9, 12, 10, 12, 11, 12, 12], [23, 9, 23, 10, 23, 7, 23, 8, 22, 7, 22, 8], [25, 9, 25, 10, 24, 9, 24, 10, 24, 11, 24, 12], [35, 9, 35, 10, 35, 7, 35, 8, 34, 7, 34, 8], [6, 10, 6, 11, 17, 10, 17, 11], [8, 10, 8, 11, 15, 10, 15, 11], [10, 10, 10, 11, 13, 10, 13, 11], [12, 10, 12, 11, 23, 10, 23, 11], [14, 10, 14, 11, 21, 10, 21, 11], [16, 10, 16, 11, 19, 10, 19, 11], [18, 10, 18, 11, 29, 10, 29, 11], [20, 10, 20, 11, 27, 10, 27, 11], [22, 10, 22, 11, 25, 10, 25, 11], [30, 10, 30, 11, 30, 8, 30, 9, 29, 8, 29, 9], [28, 10, 28, 11, 31, 10, 31, 11, 31, 12, 31, 13], [32, 10, 32, 11, 32, 8, 32, 9, 27, 8, 27, 9], [26, 10, 26, 11, 33, 10, 33, 11, 33, 12, 33, 13], [34, 10, 34, 11, 34, 8, 34, 9, 25, 8, 25, 9], [24, 10, 24, 11, 35, 10, 35, 11, 35, 12, 35, 13], [1, 11, 1, 12, 2, 11, 2, 12], [3, 11, 3, 12, 4, 11, 4, 12], [9, 11, 9, 12, 8, 11, 8, 12], [13, 11, 13, 12, 14, 11, 14, 12], [15, 11, 15, 12, 16, 11, 16, 12], [21, 11, 21, 12, 20, 11, 20, 12], [25, 11, 25, 12, 26, 11, 26, 12], [27, 11, 27, 12, 28, 11, 28, 12], [33, 11, 33, 12, 32, 11, 32, 12], [5, 11, 5, 12, 5, 9, 5, 10, 4, 9, 4, 10], [7, 11, 7, 12, 6, 11, 6, 12, 6, 13, 6, 14], [17, 11, 17, 12, 17, 9, 17, 10, 16, 9, 16, 10], [19, 11, 19, 12, 18, 11, 18, 12, 18, 13, 18, 14], [29, 11, 29, 12, 29, 9, 29, 10, 28, 9, 28, 10], [31, 11, 31, 12, 30, 11, 30, 12, 30, 13, 30, 14], [12, 12, 12, 13, 11, 12, 11, 13], [14, 12, 14, 13, 9, 12, 9, 13], [16, 12, 16, 13, 7, 12, 7, 13], [18, 12, 18, 13, 17, 12, 17, 13], [20, 12, 20, 13, 15, 12, 15, 13], [22, 12, 22, 13, 13, 12, 13, 13], [24, 12, 24, 13, 23, 12, 23, 13], [26, 12, 26, 13, 21, 12, 21, 13], [28, 12, 28, 13, 19, 12, 19, 13], [0, 12, 0, 13, 0, 10, 0, 11, 11, 10, 11, 11], [10, 12, 10, 13, 1, 12, 1, 13, 1, 14, 1, 15], [2, 12, 2, 13, 2, 10, 2, 11, 9, 10, 9, 11], [8, 12, 8, 13, 3, 12, 3, 13, 3, 14, 3, 15], [4, 12, 4, 13, 4, 10, 4, 11, 7, 10, 7, 11], [6, 12, 6, 13, 5, 12, 5, 13, 5, 14, 5, 15], [3, 13, 3, 14, 2, 13, 2, 14], [7, 13, 7, 14, 8, 13, 8, 14], [9, 13, 9, 14, 10, 13, 10, 14], [15, 13, 15, 14, 14, 13, 14, 14], [19, 13, 19, 14, 20, 13, 20, 14], [21, 13, 21, 14, 22, 13, 22, 14], [27, 13, 27, 14, 26, 13, 26, 14], [31, 13, 31, 14, 32, 13, 32, 14], [33, 13, 33, 14, 34, 13, 34, 14], [1, 13, 1, 14, 0, 13, 0, 14, 0, 15, 0, 16], [11, 13, 11, 14, 11, 11, 11, 12, 10, 11, 10, 12], [13, 13, 13, 14, 12, 13, 12, 14, 12, 15, 12, 16], [23, 13, 23, 14, 23, 11, 23, 12, 22, 11, 22, 12], [25, 13, 25, 14, 24, 13, 24, 14, 24, 15, 24, 16], [35, 13, 35, 14, 35, 11, 35, 12, 34, 11, 34, 12], [6, 14, 6, 15, 17, 14, 17, 15], [8, 14, 8, 15, 15, 14, 15, 15], [10, 14, 10, 15, 13, 14, 13, 15], [12, 14, 12, 15, 23, 14, 23, 15], [14, 14, 14, 15, 21, 14, 21, 15], [16, 14, 16, 15, 19, 14, 19, 15], [18, 14, 18, 15, 29, 14, 29, 15], [20, 14, 20, 15, 27, 14, 27, 15], [22, 14, 22, 15, 25, 14, 25, 15], [30, 14, 30, 15, 30, 12, 30, 13, 29, 12, 29, 13], [32, 14, 32, 15, 32, 12, 32, 13, 27, 12, 27, 13], [34, 14, 34, 15, 34, 12, 34, 13, 25, 12, 25, 13], [1, 15, 1, 16, 2, 15, 2, 16], [3, 15, 3, 16, 4, 15, 4, 16], [9, 15, 9, 16, 8, 15, 8, 16], [13, 15, 13, 16, 14, 15, 14, 16], [15, 15, 15, 16, 16, 15, 16, 16], [21, 15, 21, 16, 20, 15, 20, 16], [25, 15, 25, 16, 26, 15, 26, 16], [27, 15, 27, 16, 28, 15, 28, 16], [33, 15, 33, 16, 32, 15, 32, 16], [5, 15, 5, 16, 5, 13, 5, 14, 4, 13, 4, 14], [17, 15, 17, 16, 17, 13, 17, 14, 16, 13, 16, 14], [29, 15, 29, 16, 29, 13, 29, 14, 28, 13, 28, 14]

TABLE 22B

[28, 14, 28, 15, 31, 14, 31, 15, 31, 16, 0, 0], [26, 14, 26, 15, 33, 14, 33, 15, 33, 16, 0, 0], [24, 14, 24, 15, 35, 14, 35, 15, 35, 16, 0, 0], [7, 15, 7, 16, 6, 15, 6, 16], [11, 15, 11, 16, 10, 15, 10, 16], [19, 15, 19, 16, 18, 15, 18, 16], [23, 15, 23, 16, 22, 15, 22, 16], [31, 15, 31, 16, 30, 15, 30, 16], [35, 15, 35, 16, 34, 15, 34, 16], [6, 16, 0, 0, 5, 16, 0, 0], [8, 16, 0, 0, 3, 16, 0, 0], [10, 16, 0, 0, 1, 16, 0, 0], [12, 16, 0, 0, 11, 16, 0, 0], [14, 16, 0, 0, 9, 16, 0, 0], [16, 16, 0, 0, 7, 16, 0, 0], [18, 16, 0, 0, 17, 16, 0, 0], [20, 16, 0, 0, 15, 16, 0, 0], [22, 16, 0, 0, 13, 16, 0, 0], [24, 16, 0, 0, 23, 16, 0, 0], [26, 16, 0, 0, 21, 16, 0, 0], [28, 16, 0, 0, 19, 16, 0, 0], [30, 16, 0, 0, 29, 16, 0, 0], [32, 16, 0, 0, 27, 16, 0, 0], [34, 16, 0, 0, 25, 16, 0, 0], [0, 16, 0, 0, 14, 0, 15, 11, 14, 11, 15], [2, 16, 0, 0, 2, 14, 2, 15, 9, 14, 9, 15], [4, 16, 0, 0, 4, 14, 4, 15, 7, 14, 7, 15]

The core oligonucleotide sequences used to produce 6H×6H×256B nucleic acid structures of the invention are designated SEQ ID NOs. 3703-4182, and the corresponding voxel coordinates are shown respectively in Table 23A. The end oligonucleotide sequences used to produce 6H×6H×256B nucleic acid structures of the invention are designated SEQ ID NOs. 4264-4290, and the corresponding voxel coordinates are shown respectively in Table 23B. (See also Appendix, Table 9 of U.S. provisional application No. 61/675,309, filed Jul. 24, 2012, incorporated by reference herein.)

TABLE 23A

[0, 0, 0, 1, 0, 0, 0, 0], [0, 0, 2, 1, 0, 0, 0, 0], [0, 0, 4, 1, 0, 0, 0, 0], [0, 0, 31, 1, 0, 0, 0, 0], [0, 0, 33, 1, 0, 0, 0, 0], [0, 0, 35, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 10, 1, 0, 0, 1, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [11, 1, 11, 2, 0, 0, 0, 0], [18, 1, 18, 2, 0, 0, 0, 0], [23, 1, 23, 2, 0, 0, 0, 0], [30, 1, 30, 2, 0, 0, 0, 0], [35, 1, 35, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2,

TABLE 23A-continued 34, 1, 34, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [30, 2, 30, 3, 0, 0, 30, 1, 0, 0, 29, 1], [32, 2, 32, 3, 0, 0, 32, 1, 0, 0, 27, 1], [34, 2, 34, 3, 0, 0, 34, 1, 0, 0, 25, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2], [28, 2, 28, 3, 31, 2, 31, 3, 31, 4, 31, 5], [26, 2, 26, 3, 33, 2, 33, 3, 33, 4, 33, 5], [24, 2, 24, 3, 35, 2, 35, 3, 35, 4, 35, 5], [7, 3, 7, 4, 6, 3, 6, 4, 6, 5, 6, 6], [19, 3, 19, 4, 18, 3, 18, 4, 18, 5, 18, 6], [31, 3, 31, 4, 30, 3, 30, 4, 30, 5, 30, 6], [12, 4, 12, 5, 11, 4, 11, 5], [14, 4, 14, 5, 9, 4, 9, 5], [16, 4, 16, 5, 7, 4, 7, 5], [18, 4, 18, 5, 17, 4, 17, 5], [20, 4, 20, 5, 15, 4, 15, 5], [22, 4, 22, 5, 13, 4, 13, 5], [24, 4, 24, 5, 23, 4, 23, 5], [26, 4, 26, 5, 21, 4, 21, 5], [28, 4, 28, 5, 19, 4, 19, 5], [0, 4, 0, 5, 0, 2, 0, 3, 11, 2, 11, 3], [10, 4, 10, 5, 1, 4, 1, 5, 1, 6, 1, 7], [2, 4, 2, 5, 2, 2, 2, 3, 9, 2, 9, 3], [8, 4, 8, 5, 3, 4, 3, 5, 3, 6, 3, 7], [4, 4, 4, 5, 4, 2, 4, 3, 7, 2, 7, 3], [6, 4, 6, 5, 5, 4, 5, 5, 5, 6, 5, 7], [3, 5, 3, 6, 2, 5, 2, 6], [7, 5, 7, 6, 8, 5, 8, 6], [9, 5, 9, 6, 10, 5, 10, 6], [15, 5, 15, 6, 14, 5, 14, 6], [19, 5, 19, 6, 20, 5, 20, 6], [21, 5, 21, 6, 22, 5, 22, 6], [27, 5, 27, 6, 26, 5, 26, 6], [31, 5, 31, 6, 32, 5, 32, 6], [33, 5, 33, 6, 34, 5, 34, 6], [1, 5, 1, 6, 0, 5, 0, 6, 0, 7, 0, 8], [11, 5, 11, 6, 11, 3, 11, 4, 10, 3, 10, 4], [13, 5, 13, 6, 12, 5, 12, 6, 12, 7, 12, 8], [23, 5, 23, 6, 23, 3, 23, 4, 22, 3, 22, 4], [25, 5, 25, 6, 24, 5, 24, 6, 24, 7, 24, 8], [35, 5, 35, 6, 35, 3, 35, 4, 34, 3, 34, 4], [6, 6, 6, 7, 17, 6, 17, 7], [8, 6, 8, 7, 15, 6, 15, 7], [10, 6, 10, 7, 13, 6, 13, 7], [12, 6, 12, 7, 23, 6, 23, 7], [14, 6, 14, 7, 21, 6, 21, 7], [16, 6, 16, 7, 19, 6, 19, 7], [18, 6, 18, 7, 29, 6, 29, 7], [20, 6, 20, 7, 27, 6, 27, 7], [22, 6, 22, 7, 25, 6, 25, 7], [30, 6, 30, 7, 30, 4, 30, 5, 29, 4, 29, 5], [32, 6, 32, 7, 32, 4, 32, 5, 27, 4, 27, 5], [34, 6, 34, 7, 34, 4, 34, 5, 25, 4, 25, 5], [1, 7, 1, 8, 2, 7, 2, 8], [3, 7, 3, 8, 4, 7, 4, 8], [9, 7, 9, 8, 8, 7, 8, 8], [13, 7, 13, 8, 14, 7, 14, 8], [15, 7, 15, 8, 16, 7, 16, 8], [21, 7, 21, 8, 20, 7, 20, 8], [25, 7, 25, 8, 26, 7, 26, 8], [27, 7, 27, 8, 28, 7, 28, 8], [33, 7, 33, 8, 32, 7, 32, 8], [5, 7, 5, 8, 5, 5, 5, 6, 4, 5, 4, 6], [17, 7, 17, 8, 17, 5, 17, 6, 16, 5, 16, 6], [29, 7, 29, 8, 29, 5, 29, 6, 28, 5, 28, 6], [28, 6, 28, 7, 31, 6, 31, 7, 31, 8, 31, 9], [26, 6, 26, 7, 33, 6, 33, 7, 33, 8, 33, 9], [24, 6, 24, 7, 35, 6, 35, 7, 35, 8, 35, 9], [7, 7, 7, 8, 6, 7, 6, 8, 6, 9, 6, 10], [19, 7, 19, 8, 18, 7, 18, 8, 18, 9, 18, 10], [31, 7, 31, 8, 30, 7, 30, 8, 30, 9, 30, 10], [12, 8, 12, 9, 11, 8, 11, 9], [14, 8, 14, 9, 9, 8, 9, 9], [16, 8, 16, 9, 7, 8, 7, 9], [18, 8, 18, 9, 17, 8, 17, 9], [20, 8, 20, 9, 15, 8, 15, 9], [22, 8, 22, 9, 13, 8, 13, 9], [24, 8, 24, 9, 23, 8, 23, 9], [26, 8, 26, 9, 21, 8, 21, 9], [28, 8, 28, 9, 19, 8, 19, 9], [0, 8, 0, 9, 0, 6, 0, 7, 11, 6, 11, 7], [10, 8, 10, 9, 1, 8, 1, 9, 1, 10, 1, 11], [2, 8, 2, 9, 2, 6, 2, 7, 9, 6, 9, 7], [8, 8, 8, 9, 3, 8, 3, 9, 3, 10, 3, 11], [4, 8, 4, 9, 4, 6, 4, 7, 7, 6, 7, 7], [6, 8, 6, 9, 5, 8, 5, 9, 5, 10, 5, 11], [7, 9, 7, 10, 8, 9, 8, 10], [9, 9, 9, 10, 10, 9, 10, 10], [15, 9, 15, 10, 14, 9, 14, 10], [19, 9, 19, 10, 20, 9, 20, 10], [21, 9, 21, 10, 22, 9, 22, 10], [27, 9, 27, 10, 26, 9, 26, 10], [31, 9, 31, 10, 32, 9, 32, 10], [33, 9, 33, 10, 34, 9, 34, 10], [1, 9, 1, 10, 0, 9, 0, 10, 0, 11, 0, 12], [11, 9, 11, 10, 11, 7, 11, 8, 10, 7, 10, 8], [13, 9, 13, 10, 12, 9, 12, 10, 12, 11, 12, 12], [23, 9, 23, 10, 23, 7, 23, 8, 22, 7, 22, 8], [25, 9, 25, 10, 24, 9, 24, 10, 24, 11, 24, 12], [35, 9, 35, 10, 35, 7, 35, 8, 34, 7, 34, 8], [6, 10, 6, 11, 17, 10, 17, 11], [8, 10, 8, 11, 15, 10, 15, 11], [10, 10, 10, 11, 13, 10, 13, 11], [12, 10, 12, 11, 23, 10, 23, 11], [14, 10, 14, 11, 21, 10, 21, 11], [16, 10, 16, 11, 19, 10, 19, 11], [18, 10, 18, 11, 29, 10, 29, 11], [20, 10, 20, 11, 27, 10, 27, 11], [22, 10, 22, 11, 25, 10, 25, 11], [30, 10, 30, 11, 30, 8, 30, 9, 29, 8, 29, 9], [28, 10, 28, 11, 31, 10, 31, 11, 31, 12, 31, 13], [32, 10, 32, 11, 32, 8, 32, 9, 27, 8, 27, 9], [26, 10, 26, 11, 33, 10, 33, 11, 33, 12, 33, 13], [34, 10, 34, 11, 34, 8, 34, 9, 25, 8, 25, 9], [24, 10, 24, 11, 35, 10, 35, 11, 35, 12, 35, 13], [1, 11, 1, 12, 2, 11, 2, 12], [3, 11, 3, 12, 4, 11, 4, 12], [9, 11, 9, 12, 8, 11, 8, 12], [13, 11, 13, 12, 14, 11, 14, 12], [15, 11, 15, 12, 16, 11, 16, 12], [21, 11, 21, 12, 20, 11, 20, 12], [25, 11, 25, 12, 26, 11, 26, 12], [27, 11, 27, 12, 28, 11, 28, 12], [33, 11, 33, 12, 32, 11, 32, 12], [5, 11, 5, 12, 5, 9, 5, 10, 4, 9, 4, 10], [7, 11, 7, 12, 6, 11, 6, 12, 6, 13, 6, 14], [17, 11, 17, 12, 17, 9, 17, 10, 16, 9, 16, 10], [19, 11, 19, 12, 18, 11, 18, 12, 18, 13, 18, 14], [29, 11, 29, 12, 29, 9, 29, 10, 28, 9, 28, 10], [31, 11, 31, 12, 30, 11, 30, 12, 30, 13, 30, 14], [12, 12, 12, 13, 11, 12, 11, 13], [14, 12, 14, 13, 9, 12, 9, 13], [16, 12, 16, 13, 7, 12, 7, 13], [18, 12, 18, 13, 17, 12, 17, 13], [20, 12, 20, 13, 15, 12, 15, 13], [22, 12, 22, 13, 13, 12, 13, 13], [26, 12, 26, 13, 21, 12, 21, 13], [28, 12, 28, 13, 19, 12, 19, 13], [0, 12, 0, 13, 0, 10, 0, 11, 11, 10, 11, 11], [10, 12, 10, 13, 1, 12, 1, 13, 1, 14, 1, 15], [2, 12, 2, 13, 2, 10, 2, 11, 9, 10, 9, 11], [8, 12, 8, 13, 3, 12, 3, 13, 3, 14, 3, 15], [4, 12, 4, 13, 4, 10, 4, 11, 7, 10, 7, 11], [6, 12, 6, 13, 5, 12, 5, 13, 5, 14, 5, 15], [3, 13, 3, 14, 2, 13, 2, 14], [7, 13, 7, 14, 8, 13, 8, 14], [9, 13, 9, 14, 10, 13, 10, 14], [15, 13, 15, 14, 14, 13, 14, 14], [19, 13, 19, 14, 20, 13, 20, 14], [21, 13, 21, 14, 22, 13, 22, 14], [27, 13, 27, 14, 26, 13, 26, 14], [31, 13, 31, 14, 32, 13, 32, 14], [33, 13, 33, 14, 34, 13, 34, 14], [1, 13, 1, 14, 0, 13, 0, 14, 0, 15, 0, 16], [11, 13, 11, 14, 11, 11, 11, 12, 10, 11, 10, 12], [13, 13, 13, 14, 12, 13, 12, 14, 12, 15, 12, 16], [23, 13, 23, 14, 23, 11, 23, 12, 22, 11, 22, 12], [25, 13, 25, 14, 24, 13, 24, 14, 24, 15, 24, 16], [35, 13, 35, 14, 35, 11, 35, 12, 34, 11, 34, 12], [6, 14, 6, 15, 17, 14, 17, 15], [8, 14, 8, 15, 15, 14, 15, 15], [10, 14, 10, 15, 13, 14, 13, 15], [12, 14, 12, 15, 23, 14, 23, 15], [14, 14, 14, 15, 21, 14, 21, 15], [16, 14, 16, 15, 19, 14, 19, 15], [18, 14, 18, 15, 29, 14, 29, 15], [22, 14, 22, 15, 25, 14, 25, 15], [30, 14, 30, 15, 30, 12, 30, 13, 29, 12, 29, 13], [32, 14, 32, 15, 32, 12, 32, 13, 27, 12, 27, 13], [34, 14, 34, 15, 34, 12, 34, 13, 25, 12, 25, 13], [1, 15, 1, 16, 2, 15, 2, 16], [3, 15, 3, 16, 4, 15, 4, 16], [9, 15, 9, 16, 8, 15, 8, 16], [13, 15, 13, 16, 14, 15, 14, 16], [15, 15, 15, 16, 16, 15, 16, 16], [21, 15, 21, 16, 20, 15, 20, 16], [25, 15, 25, 16, 26, 15, 26, 16], [27, 15, 27, 16, 28, 15, 28, 16], [33, 15, 33, 16, 32, 15, 32, 16], [5, 15, 5, 16, 5, 13, 5, 14, 4, 13, 4, 14], [17, 15, 17, 16, 17, 13, 17, 14, 16, 13, 16, 14], [29, 15, 29, 16, 29, 13, 29, 14, 28, 13, 28, 14], [28, 14, 28, 15, 31, 14, 31, 15, 31, 16, 31, 17], [26, 14, 26, 15, 33, 14, 33, 15, 33, 16, 33, 17], [24, 14, 24, 15, 35, 14, 35, 15, 35, 16, 35, 17], [7, 15, 7, 16, 6, 15, 6, 16, 6, 17, 6, 18], [19, 15, 19, 16, 18, 15, 18, 16, 18, 17, 18, 18], [31, 15, 31, 16, 30, 15, 30, 16, 30, 17, 30, 18], [12, 16, 12, 17, 11, 16, 11, 17], [14, 16, 14, 17, 9, 16, 9, 17], [16, 16, 16, 17, 7, 16, 7, 17], [18, 16, 18, 17, 17, 16, 17, 17], [20, 16, 20, 17, 15, 16, 15, 17], [22, 16, 22, 17, 13, 16, 13, 17], [24, 16, 24, 17, 23, 16, 23, 17], [26, 16, 26, 17, 21, 16, 21, 17], [28, 16, 28, 17, 19, 16, 19, 17], [0, 16, 0, 17, 0, 14, 0, 15, 11, 14, 11, 15], [10, 16, 10, 17, 1, 16, 1, 17, 1, 18, 1, 19], [2, 16, 2, 17, 2, 14, 2, 15, 9, 14, 9, 15], [8, 16, 8, 17, 3, 16, 3, 17, 3, 18, 3, 19], [4, 16, 4, 17, 4, 14, 4, 15, 7, 14, 7, 15], [6, 16, 6, 17, 5, 16, 5, 17, 5, 18, 5, 19], [3, 17, 3, 18, 2, 17, 2, 18], [7, 17, 7, 18, 8, 17, 8, 18], [9, 17, 9, 18, 10, 17, 10, 18], [15, 17, 15, 18, 14, 17, 14, 18], [19, 17, 19, 18, 20, 17, 20, 18], [21, 17, 21, 18, 22, 17, 22, 18], [27, 17, 27, 18, 26, 17, 26, 18], [31, 17, 31, 18, 32, 17, 32, 18], [33, 17, 33, 18, 34, 17, 34, 18], [1, 17, 1, 18, 0, 17, 0, 18, 0, 19, 0, 20], [11, 17, 11, 18, 11, 15, 11, 16, 10, 15, 10, 16], [13, 17, 13, 18, 12, 17, 12, 18, 12, 19, 12, 20], [23, 17, 23, 18, 23, 15, 23, 16, 22, 15, 22, 16], [25, 17, 25, 18, 24, 17, 24, 18, 24, 19, 24, 20], [35, 17, 35, 18, 35, 15, 35, 16, 34, 15, 34, 16], [6, 18, 6, 19, 17, 18, 17, 19], [8, 18, 8, 19, 15, 18, 15, 19], [10, 18, 10, 19, 13, 18, 13, 19], [12, 18, 12, 19, 23, 18, 23, 19], [14, 18, 14, 19, 21, 18, 21, 19], [16, 18, 16, 19, 19, 18, 19, 19], [18, 18, 18, 19, 29, 18, 29, 19], [20, 18, 20, 19, 27, 18, 27, 19], [22, 18, 22, 19, 25, 18, 25, 19], [30, 18, 30, 19, 30, 16, 30, 17, 29, 16, 29, 17], [28, 18, 28, 19, 31, 18, 31, 19, 31, 20, 31, 21], [32, 18, 32, 19, 32, 16, 32, 17, 27, 16, 27, 17], [26, 18, 26, 19, 33, 18, 33, 19, 33, 20, 33, 21], [34, 18, 34, 19, 34, 16, 34, 17, 25, 16, 25, 17], [24, 18, 24, 19, 35, 18, 35, 19, 35, 20, 35, 21], [1, 19, 1, 20, 2, 19, 2, 20], [3, 19, 3, 20, 4, 19, 4, 20], [9, 19, 9, 20, 8, 19, 8, 20], [13, 19, 13, 20, 14, 19, 14, 20], [15, 19, 15, 20, 16, 19, 16, 20], [21, 19, 21, 20, 20, 19, 20, 20], [25, 19, 25, 20, 26, 19, 26, 20], [27, 19, 27, 20, 28, 19, 28, 20], [33, 19, 33, 20, 32, 19, 32, 20], [5, 19, 5, 20, 5, 17, 5, 18, 4, 17, 4, 18], [7, 19, 7, 20, 6, 19, 6, 20, 6, 21, 6, 22], [17, 19, 17, 20, 17, 17, 17, 18, 16, 17, 16, 18], [19, 19, 19, 20, 18, 19, 18, 20, 18, 21, 18, 22], [29, 19, 29, 20, 29, 17, 29, 18, 28, 17, 28, 18], [31, 19, 31, 20, 30, 19, 30, 20, 30, 21, 30, 22], [12, 20, 12, 21, 11, 20, 11, 21], [14, 20, 14, 21, 9, 20, 9, 21], [16, 20, 16, 21, 7, 20, 7, 21], [18, 20, 18, 21, 17, 20, 17, 21], [20, 20, 20, 21, 15, 20, 15, 21], [22, 20, 22, 21, 13, 20, 13, 21], [24, 20, 24, 21, 23, 20, 23, 21], [26, 20, 26, 21, 21, 20, 21, 21], [28, 20, 28, 21, 19, 20, 19, 21], [0, 20, 0, 21, 0, 18, 0, 19, 11, 18, 11, 19], [10, 20, 10, 21, 1, 20, 1, 21, 1, 22, 1, 23], [2, 20, 2, 21, 2, 18, 2, 19, 9, 18, 9, 19], [8, 20, 8, 21, 3, 20, 3, 21, 3, 22, 3, 23], [4, 20, 4, 21, 4, 18, 4, 19, 7, 18, 7, 19], [6, 20, 6, 21, 5, 20, 5, 21, 5, 22, 5, 23], [3, 21, 3, 22, 2, 21, 2, 22], [7, 21, 7, 22, 8, 21, 8, 22], [9, 21, 9, 22, 10, 21, 10, 22], [15, 21, 15, 22, 14, 21, 14, 22], [19, 21, 19, 22, 20, 21, 20, 22], [21, 21, 21, 22, 22, 21, 22, 22], [27, 21, 27, 22, 26, 21, 26, 22], [31, 21, 31, 22, 32, 21, 32, 22], [33, 21, 33, 22, 34, 21, 34, 22], [1, 21, 1, 22, 0, 21, 0, 22, 0, 23, 0, 24], [11, 21, 11, 22, 11, 19, 11, 20, 10, 19, 10, 20], [13, 21, 13, 22, 12, 21, 12, 22, 12, 23, 12, 24], [23, 21, 23, 22, 23, 19, 23, 20, 22, 19, 22, 20], [25, 21, 25, 22, 24, 21, 24, 22, 24, 23, 24, 24], [35, 21, 35, 22, 35, 19, 35, 20, 34, 19, 34, 20], [6, 22, 6, 23, 17, 22, 17, 23], [8, 22, 8, 23, 15, 22, 15, 23], [10, 22, 10, 23, 13, 22, 13, 23], [12, 22, 12, 23, 23, 22, 23, 23], [14, 22, 14, 23, 21, 22, 21, 23], [16, 22, 16, 23, 19, 22, 19, 23], [18, 22, 18, 23, 29, 22, 29, 23], [20, 22, 20, 23, 27, 22, 27, 23], [22, 22, 22, 23, 25, 22, 25, 23], [30, 22, 30, 23, 30, 20, 30, 21, 29, 20, 29, 2 1], [28, 22, 28, 23, 31, 22, 31, 23, 31, 24, 31, 25], [32, 22, 32, 23, 32, 20, 32, 21, 27, 20, 27, 21], [26, 22, 26, 23, 33, 22, 33, 23, 33, 24, 33,

TABLE 23A-continued

25], [34, 22, 34, 23, 34, 20, 34, 21, 25, 20, 25, 21], [24, 22, 24, 23, 35, 22, 35, 23, 35, 24, 35, 25], [1, 23, 1, 24, 2, 23, 2, 24], [3, 23, 3, 24, 4, 23, 4, 24], [9, 23, 9, 24, 8, 23, 8, 24], [13, 23, 13, 24, 14, 23, 14, 24], [15, 23, 15, 24, 16, 23, 16, 24], [21, 23, 21, 24, 20, 23, 20, 24], [25, 23, 25, 24, 26, 23, 26, 24], [27, 23, 27, 24, 28, 23, 28, 24], [33, 23, 33, 24, 32, 23, 32, 24], [5, 23, 5, 24, 5, 21, 5, 22, 4, 21, 4 , 22], [7, 23, 7, 24, 6, 23, 6, 24, 6, 25, 6, 26], [17, 23, 17, 24, 17, 21, 17, 22, 16, 21, 16, 22], [19, 23, 19, 24, 18, 23, 18, 24, 18, 25, 18, 26], [29, 23, 29, 24, 29, 21, 29, 22, 28, 21, 28, 22], [31, 23, 31, 24, 30, 23, 30, 24, 30, 25, 30, 26], [12, 24, 12, 25, 11, 24, 11, 25], [14, 24, 14, 25, 9, 24, 9, 25], [16, 24, 16, 25, 7, 24, 7, 25], [18, 24, 18, 25, 17, 24, 17, 25], [20, 24, 20, 25, 15, 24, 15, 25], [22, 24, 22, 25, 13, 24, 13, 25], [24, 24, 24, 25, 23, 24, 23, 25], [26, 24, 26, 25, 21, 24, 21, 25], [28, 24, 28, 25, 19, 24, 19, 25], [0, 24, 0, 25, 0, 22, 0, 23, 11, 22, 11, 23], [10, 24, 10, 25, 1, 24, 1, 25, 1, 26, 1, 27], [2, 24, 2, 25, 2, 22, 2, 23, 9, 22, 9, 23], [8, 24, 8, 25, 3, 24, 3, 25, 3, 26, 3, 27], [4, 24, 4, 25, 4, 22, 4, 23, 7, 22, 7, 23], [6, 24, 6, 25, 5, 24, 5, 25, 5, 26, 5, 27], [3, 25, 3, 26, 2, 25, 2, 26], [7, 25, 7, 26, 8, 25, 8, 26], [9, 25, 9, 26, 10, 25, 10, 26], [15, 25, 15, 26, 14, 25, 14, 26], [19, 25, 19, 26, 20, 25, 20, 26], [21, 25, 21, 26, 22, 25, 22, 26], [27, 25, 27, 26, 26, 25, 26, 26], [31, 25, 31, 26, 32, 25, 32, 26], [33, 25, 33, 26, 34, 25, 34, 26], [1, 25, 1, 26, 0, 25, 0, 26, 0, 27, 0, 28], [11, 25, 11, 26, 11, 23, 11, 24, 10, 23, 10, 24], [13, 25, 13, 26, 12, 25, 12, 26, 12, 27, 12, 28], [23, 25, 23, 26, 23, 23, 23, 24, 22, 23, 22, 24], [25, 25, 25, 26, 24, 25, 24, 26, 24, 27, 24, 28], [35, 25, 35, 26, 35, 23, 35, 24, 34, 23, 34, 24], [6, 26, 6, 27, 17, 26, 17, 27], [8, 26, 8, 27, 15, 26, 15, 27], [10, 26, 10, 27, 13, 26, 13, 27], [12, 26, 12, 27, 23, 26, 23, 27], [14, 26, 14, 27, 21, 26, 21, 27], [16, 26, 16, 27, 19, 26, 19, 27], [18, 26, 18, 27, 29, 26, 29, 27], [20, 26, 20, 27, 27, 26, 27, 27], [22, 26, 22, 27, 25, 26, 25, 27], [30, 26, 30, 27, 30, 24, 30, 25, 29, 24, 29, 25], [28, 26, 28, 27, 31, 26, 31, 27, 31, 28, 31, 29], [32, 26, 32, 27, 32, 24, 32, 25, 27, 24, 27, 25], [26, 26, 26, 27, 33, 26, 33, 27, 33, 28, 33, 29], [34, 26, 34, 27, 34, 24, 34, 25, 25, 24, 25, 25], [24, 26, 24, 27, 35, 26, 35, 27, 35, 28, 35, 29], [1, 27, 1, 28, 2, 27, 2, 28], [3, 27, 3, 28, 4, 27, 4, 28], [9, 27, 9, 28, 8, 27, 8, 28], [13, 27, 13, 28, 14, 27, 14, 28], [15, 27, 15, 28, 16, 27, 16, 28], [21, 27, 21, 28, 20, 27, 20, 28], [25, 27, 25, 28, 26, 27, 26, 28], [27, 27, 27, 28, 28, 27, 28, 28], [33, 27, 33, 28, 32, 27, 32, 28], [5, 27, 5, 28, 5, 25, 5, 26, 4, 25, 4, 26], [7, 27, 7, 28, 6, 27, 6, 28, 6, 29, 6, 30], [17, 27, 17, 28, 17, 25, 17, 26, 16, 25, 16, 26], [19, 27, 19, 28, 18, 27, 18, 28, 18, 29, 18, 30], [29, 27, 29, 28, 29, 25, 29, 26, 28, 25, 28, 26], [31, 27, 31, 28, 30, 27, 30, 28, 30, 29, 30, 30], [12, 28, 12, 29, 11, 28, 11, 29], [14, 28, 14, 29, 9, 28, 9, 29], [16, 28, 16, 29, 7, 28, 7, 29], [18, 28, 18, 29, 17, 28, 17, 29], [20, 28, 20, 29, 15, 28, 15, 29], [22, 28, 22, 29, 13, 28, 13, 29], [24, 28, 24, 29, 23, 28, 23, 29], [26, 28, 26, 29, 21, 28, 21, 29], [28, 28, 28, 29, 19, 28, 19, 29], [0, 28, 0, 29, 0, 26, 0, 27, 11, 26, 11, 27], [10, 28, 10, 29, 1, 28, 1, 29, 1, 30, 1, 31], [2, 28, 2, 29, 2, 26, 2, 27, 9, 26, 9, 27], [8, 28, 8, 29, 3, 28, 3, 29, 3, 30, 3, 31], [4, 28, 4, 29, 4, 26, 4, 27, 7, 26, 7, 27], [6, 28, 6, 29, 5, 28, 5, 29, 5, 30, 5, 31], [3, 29, 3, 30, 2, 29, 2, 30], [7, 29, 7, 30, 8, 29, 8, 30], [9, 29, 9, 30, 10, 29, 10, 30], [15, 29, 15, 30, 14, 29, 14, 30], [19, 29, 19, 30, 20, 29, 20, 30], [21, 29, 21, 30, 22, 29, 22, 30], [27, 29, 27, 30, 26, 29, 26, 30], [31, 29, 31, 30, 32, 29, 32, 30], [33, 29, 33, 30, 34, 29, 34, 30], [1, 29, 1, 30, 0, 29, 0, 30, 0, 31, 0, 32], [11, 29, 11, 30, 11, 27, 11, 28, 10, 27, 10, 28], [13, 29, 13, 30, 12, 29, 12, 30, 12, 31, 12, 32], [23, 29, 23, 30, 23, 27, 23, 28, 22, 27, 22, 28], [25, 29, 25, 30, 24, 29, 24, 30, 24, 31, 24, 32], [35, 29, 35, 30, 35, 27, 35, 28, 34, 27, 34, 28], [6, 30, 6, 31, 17, 30, 17, 31], [8, 30, 8, 31, 15, 30, 15, 31], [10, 30, 10, 31, 13, 30, 13, 31], [12, 30, 12, 31, 23, 30, 23, 31], [14, 30, 14, 31, 21, 30, 21, 31], [16, 30, 16, 31, 19, 30, 19, 31], [18, 30, 18, 31, 29, 30, 29, 31], [20, 30, 20, 31, 27, 30, 27, 31], [22, 30, 22, 31, 25, 30, 25, 31], [30, 30, 30, 31, 30, 28, 30, 29, 29, 28, 29, 29], [32, 30, 32, 31, 32, 28, 32, 29, 27, 28, 27, 29], [34, 30, 34, 31, 34, 28, 34, 29, 25, 28, 25, 29], [1, 31, 1, 32, 2, 31, 2, 32], [3, 31, 3, 32, 4, 31, 4, 32], [9, 31, 9, 32, 8, 31, 8, 32], [13, 31, 13, 32, 14, 31, 14, 32], [15, 31, 15, 32, 16, 31, 16, 32], [21, 31, 21, 32, 20, 31, 20, 32], [25, 31, 25, 32, 26, 31, 26, 32], [27, 31, 27, 32, 28, 31, 28, 32], [33, 31, 33, 32, 32, 31, 32, 32], [5, 31, 5, 32, 5, 29, 5, 30, 4, 29, 4, 30], [17, 31, 17, 32, 17, 29, 17, 30, 16, 29, 16, 30], [29, 31, 29, 32, 29, 29, 29, 30, 28, 29, 28, 30]

TABLE 23B

[28, 30, 28, 31, 31, 30, 31, 31, 31, 32, 0, 0], [26, 30, 26, 31, 33, 30, 33, 31, 33, 32, 0, 0], [24, 30, 24, 31, 35, 30, 35, 31, 35, 32, 0, 0], [7, 31, 7, 32, 6, 31, 6, 32], [11, 31, 11, 32, 10, 31, 10, 32], [19, 31, 19, 32, 18, 31, 18, 32], [23, 31, 23, 32, 22, 31, 22, 32], [31, 31, 31, 32, 30, 31, 30, 32], [35, 31, 35, 32, 34, 31, 34, 32], [6, 32, 0, 0, 5, 32, 0, 0], [8, 32, 0, 0, 3, 32, 0, 0], [10, 32, 0, 0, 1, 32, 0, 0], [12, 32, 0, 0, 11, 32, 0, 0], [14, 32, 0, 0, 9, 32, 0, 0], [16, 32, 0, 0, 7, 32, 0, 0], [18, 32, 0, 0, 17, 32, 0, 0], [20, 32, 0, 0, 15, 32, 0, 0], [22, 32, 0, 0, 13, 32, 0, 0], [24, 32, 0, 0, 23, 32, 0, 0], [26, 32, 0, 0, 21, 32, 0, 0], [28, 32, 0, 0, 19, 32, 0, 0], [30, 32, 0, 0, 29, 32, 0, 0], [32, 32, 0, 0, 27, 32, 0, 0], [34, 32, 0, 0, 25, 32, 0, 0], [0, 32, 0, 0, 0, 30, 0, 31, 11, 30, 11, 31],
[2, 32, 0, 0, 2, 30, 2, 31, 9, 30, 9, 31], [4, 32, 0, 0, 4, 30, 4, 31, 7, 30, 7, 31]

The core oligonucleotide sequences used to produce 6H×10H×32B nucleic acid structures of the invention are designated SEQ ID NOs. 4291-4394, and the corresponding voxel coordinates are shown respectively in Table 24A. The end oligonucleotide sequences used to produce 6H×10H×32B nucleic acid structures of the invention are designated SEQ ID NOs. 4707-4749, and the corresponding voxel coordinates are shown respectively in Table 24B. (See also Appendix, Table 10 of U.S. provisional application No. 61/675,309, filed Jul. 24, 2012, incorporated by reference herein.)

TABLE 24A

[0, 0, 0, 1, 0, 0, 0, 0], [0, 0, 2, 1, 0, 0, 0, 0], [0, 0, 4, 1, 0, 0, 0, 0], [0, 0, 55, 1, 0, 0, 0, 0], [0, 0, 57, 1, 0, 0, 0, 0], [0, 0, 59, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 30, 1, 0, 0, 29, 1], [0, 0, 32, 1, 0, 0, 27, 1], [0, 0, 34, 1, 0, 0, 25, 1], [0, 0, 36, 1, 0, 0, 35, 1], [0, 0, 38, 1, 0, 0, 33, 1], [0, 0, 40, 1, 0, 0, 31, 1], [0, 0, 42, 1, 0, 0, 41, 1], [0, 0, 44, 1, 0, 0, 39, 1], [0, 0, 46, 1, 0, 0, 37, 1], [0, 0, 48, 1, 0, 0, 47, 1], [0, 0, 50, 1, 0, 0, 45, 1], [0, 0, 52, 1, 0, 0, 43, 1], [0, 0, 10, 1, 0, 0, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [11, 1, 11, 2, 0, 0, 0, 0], [18, 1, 18, 2, 0, 0, 0, 0], [23, 1, 23, 2, 0, 0, 0, 0], [30, 1, 30, 2, 0, 0, 0, 0], [35, 1, 35, 2, 0, 0, 0, 0], [42, 1, 42, 2, 0, 0, 0, 0], [47, 1, 47, 2, 0, 0, 0, 0], [54, 1, 54, 2, 0, 0, 0, 0], [59, 1, 59, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2, 34, 1, 34, 2], [39, 1, 39, 2, 38, 1, 38, 2], [43, 1, 43, 2, 44, 1, 44, 2], [45, 1, 45, 2, 46, 1, 46, 2], [51, 1, 51, 2, 50, 1, 50, 2], [55, 1, 55, 2, 56, 1, 56, 2], [57, 1, 57, 2, 58, 1, 58, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [37, 1, 37, 2, 36, 1, 36, 2, 36, 3, 36, 4], [49, 1, 49, 2, 48, 1, 48, 2, 48, 3, 48, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [24, 2, 24, 3, 35, 2, 35, 3], [26, 2, 26, 3, 33, 2, 33, 3], [28, 2, 28, 3, 31, 2, 31, 3], [30, 2, 30, 3, 41, 2, 41, 3], [32, 2, 32, 3, 39, 2, 39, 3], [34, 2, 34, 3, 37, 2, 37, 3], [36, 2, 36, 3, 47, 2, 47, 3], [38, 2, 38, 3, 45, 2, 45, 3], [40, 2, 40, 3, 43, 2, 43, 3], [42, 2, 42, 3, 53, 2, 53, 3], [44, 2, 44, 3, 51, 2, 51, 3], [46, 2, 46, 3, 49, 2, 49, 3], [54, 2, 54, 3, 0, 0, 54, 1, 0, 0, 53, 1], [56, 2, 56, 3, 0, 0, 56, 1, 0, 0, 51, 1], [58, 2, 58, 3, 0, 0, 58, 1, 0, 0, 49, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [37, 3, 37, 4, 38, 3, 38, 4], [39, 3, 39, 4, 40, 3, 40, 4], [45, 3, 45, 4, 44, 3, 44, 4], [49, 3, 49, 4, 50, 3,

TABLE 24A-continued 50, 4], [51, 3, 51, 4, 52, 3, 52, 4], [57, 3, 57, 4, 56, 3, 56, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2], [41, 3, 41, 4, 41, 1, 41, 2, 40, 1, 40, 2], [53, 3, 53, 4, 53, 1, 53, 2, 52, 1, 52, 2]

TABLE 24B

[52, 2, 52, 3, 55, 2, 55, 3, 55, 4, 0, 0], [50, 2, 50, 3, 57, 2, 57, 3, 57, 4, 0, 0], [48, 2, 48, 3, 59, 2, 59, 3, 59, 4, 0, 0], [7, 3, 7, 4, 6, 3, 6, 4], [11, 3, 11, 4, 10, 3, 10, 4], [19, 3, 19, 4, 18, 3, 18, 4], [23, 3, 23, 4, 22, 3, 22, 4], [31, 3, 31, 4, 30, 3, 30, 4], [35, 3, 35, 4, 34, 3, 34, 4], [43, 3, 43, 4, 42, 3, 42, 4], [47, 3, 47, 4, 46, 3, 46, 4], [55, 3, 55, 4, 54, 3, 54, 4], [59, 3, 59, 4, 58, 3, 58, 4], [6, 4, 0, 0, 5, 4, 0, 0], [8, 4, 0, 0, 3, 4, 0, 0], [10, 4, 0, 0, 1, 4, 0, 0], [12, 4, 0, 0, 11, 4, 0, 0], [14, 4, 0, 0, 9, 4, 0, 0], [16, 4, 0, 0, 7, 4, 0, 0], [18, 4, 0, 0, 17, 4, 0, 0], [20, 4, 0, 0, 15, 4, 0, 0], [22, 4, 0, 0, 13, 4, 0, 0], [24, 4, 0, 0, 23, 4, 0, 0], [26, 4, 0, 0, 21, 4, 0, 0], [28, 4, 0, 0, 19, 4, 0, 0], [30, 4, 0, 0, 29, 4, 0, 0], [32, 4, 0, 0, 27, 4, 0, 0], [34, 4, 0, 0, 25, 4, 0, 0], [36, 4, 0, 0, 35, 4, 0, 0], [38, 4, 0, 0, 33, 4, 0, 0], [40, 4, 0, 0, 31, 4, 0, 0], [42, 4, 0, 0, 41, 4, 0, 0], [44, 4, 0, 0, 39, 4, 0, 0], [46, 4, 0, 0, 37, 4, 0, 0], [48, 4, 0, 0, 47, 4, 0, 0], [50, 4, 0, 0, 45, 4, 0, 0], [52, 4, 0, 0, 43, 4, 0, 0], [54, 4, 0, 0, 53, 4, 0, 0], [56, 4, 0, 0, 51, 4, 0, 0], [58, 4, 0, 0, 49, 4, 0, 0], [0, 4, 0, 0, 0, 2, 0, 3, 11, 2, 11, 3], [2, 4, 0, 0, 2, 2, 2, 3, 9, 2, 9, 3], [4, 4, 0, 0, 4, 2, 4, 3, 7, 2, 7, 3]

The core oligonucleotide sequences used to produce 6H×10H×64B nucleic acid structures of the invention are designated SEQ ID NOs. 4291-4498, and the corresponding voxel coordinates are shown respectively in Table 25A. The end oligonucleotide sequences used to produce 6H×10H× 64B nucleic acid structures of the invention are designated SEQ ID NOs. 4750-4792, and the corresponding voxel coordinates are shown respectively in Table 25B. (See also Appendix, Table 10 of U.S. provisional application No. 61/675,309, filed Jul. 24, 2012, incorporated by reference herein.)

TABLE 25A

[0, 0, 0, 1, 0, 0, 0, 0], [0, 0, 2, 1, 0, 0, 0, 0], [0, 0, 4, 1, 0, 0, 0, 0], [0, 0, 55, 1, 0, 0, 0, 0], [0, 0, 57, 1, 0, 0, 0, 0], [0, 0, 59, 1, 0, 0, 0, 0], [0, 0, 12, 1, 0, 0, 11, 1], [0, 0, 14, 1, 0, 0, 9, 1], [0, 0, 16, 1, 0, 0, 7, 1], [0, 0, 18, 1, 0, 0, 17, 1], [0, 0, 20, 1, 0, 0, 15, 1], [0, 0, 22, 1, 0, 0, 13, 1], [0, 0, 24, 1, 0, 0, 23, 1], [0, 0, 26, 1, 0, 0, 21, 1], [0, 0, 28, 1, 0, 0, 19, 1], [0, 0, 30, 1, 0, 0, 29, 1], [0, 0, 32, 1, 0, 0, 27, 1], [0, 0, 34, 1, 0, 0, 25, 1], [0, 0, 36, 1, 0, 0, 35, 1], [0, 0, 38, 1, 0, 0, 33, 1], [0, 0, 40, 1, 0, 0, 31, 1], [0, 0, 42, 1, 0, 0, 41, 1], [0, 0, 44, 1, 0, 0, 39, 1], [0, 0, 46, 1, 0, 0, 37, 1], [0, 0, 48, 1, 0, 0, 47, 1], [0, 0, 50, 1, 0, 0, 45, 1], [0, 0, 52, 1, 0, 0, 43, 1], [0, 0, 10, 1, 0, 0, 1, 1, 1, 2, 1, 3], [0, 0, 8, 1, 0, 0, 3, 1, 3, 2, 3, 3], [0, 0, 6, 1, 0, 0, 5, 1, 5, 2, 5, 3], [6, 1, 6, 2, 0, 0, 0, 0], [11, 1, 11, 2, 0, 0, 0, 0], [18, 1, 18, 2, 0, 0, 0, 0], [23, 1, 23, 2, 0, 0, 0, 0], [30, 1, 30, 2, 0, 0, 0, 0], [35, 1, 35, 2, 0, 0, 0, 0], [42, 1, 42, 2, 0, 0, 0, 0], [47, 1, 47, 2, 0, 0, 0, 0], [54, 1, 54, 2, 0, 0, 0, 0], [59, 1, 59, 2, 0, 0, 0, 0], [3, 1, 3, 2, 2, 1, 2, 2], [7, 1, 7, 2, 8, 1, 8, 2], [9, 1, 9, 2, 10, 1, 10, 2], [15, 1, 15, 2, 14, 1, 14, 2], [19, 1, 19, 2, 20, 1, 20, 2], [21, 1, 21, 2, 22, 1, 22, 2], [27, 1, 27, 2, 26, 1, 26, 2], [31, 1, 31, 2, 32, 1, 32, 2], [33, 1, 33, 2, 34, 1, 34, 2], [39, 1, 39, 2, 38, 1, 38, 2], [43, 1, 43, 2, 44, 1, 44, 2], [45, 1, 45, 2, 46, 1, 46, 2], [51, 1, 51, 2, 50, 1, 50, 2], [55, 1, 55, 2, 56, 1, 56, 2], [57, 1, 57, 2, 58, 1, 58, 2], [1, 1, 1, 2, 0, 1, 0, 2, 0, 3, 0, 4], [13, 1, 13, 2, 12, 1, 12, 2, 12, 3, 12, 4], [25, 1, 25, 2, 24, 1, 24, 2, 24, 3, 24, 4], [37, 1, 37, 2, 36, 1, 36, 2, 36, 3, 36, 4], [49, 1, 49, 2, 48, 1, 48, 2, 48, 3, 48, 4], [6, 2, 6, 3, 17, 2, 17, 3], [8, 2, 8, 3, 15, 2, 15, 3], [10, 2, 10, 3, 13, 2, 13, 3], [12, 2, 12, 3, 23, 2, 23, 3], [14, 2, 14, 3, 21, 2, 21, 3], [16, 2, 16, 3, 19, 2, 19, 3], [18, 2, 18, 3, 29, 2, 29, 3], [20, 2, 20, 3, 27, 2, 27, 3], [22, 2, 22, 3, 25, 2, 25, 3], [24, 2, 24, 3, 35, 2, 35, 3], [26, 2, 26, 3, 33, 2, 33, 3], [28, 2, 28, 3, 31, 2, 31, 3], [30, 2, 30, 3, 41, 2, 41, 3], [32, 2, 32, 3, 39, 2, 39, 3], [34, 2, 34, 3, 37, 2, 37, 3], [36, 2, 36, 3, 47, 2, 47, 3], [38, 2, 38, 3, 45, 2, 45, 3], [40, 2, 40, 3, 43, 2, 43, 3], [42, 2, 42, 3, 53, 2, 53, 3], [44, 2, 44, 3, 51, 2, 51, 3], [46, 2, 46, 3, 49, 2, 49, 3], [54, 2, 54, 3, 0, 0, 54, 1, 0, 0, 53, 1], [56, 2, 56, 3, 0, 0, 56, 1, 0, 0, 51, 1], [58, 2, 58, 3, 0, 0, 58, 1, 0, 0, 49, 1], [1, 3, 1, 4, 2, 3, 2, 4], [3, 3, 3, 4, 4, 3, 4, 4], [9, 3, 9, 4, 8, 3, 8, 4], [13, 3, 13, 4, 14, 3, 14, 4], [15, 3, 15, 4, 16, 3, 16, 4], [21, 3, 21, 4, 20, 3, 20, 4], [25, 3, 25, 4, 26, 3, 26, 4], [27, 3, 27, 4, 28, 3, 28, 4], [33, 3, 33, 4, 32, 3, 32, 4], [37, 3, 37, 4, 38, 3, 38, 4], [39, 3, 39, 4, 40, 3, 40, 4], [45, 3, 45, 4, 44, 3, 44, 4], [49, 3, 49, 4, 50, 3, 50, 4], [51, 3, 51, 4, 52, 3, 52, 4], [57, 3, 57, 4, 56, 3, 56, 4], [5, 3, 5, 4, 5, 1, 5, 2, 4, 1, 4, 2], [17, 3, 17, 4, 17, 1, 17, 2, 16, 1, 16, 2], [29, 3, 29, 4, 29, 1, 29, 2, 28, 1, 28, 2], [41, 3, 41, 4, 41, 1, 41, 2, 40, 1, 40, 2], [53, 3, 53, 4, 53, 1, 53, 2, 52, 1, 52, 2], [52, 2, 52, 3, 55, 2, 55, 3, 55, 4, 55, 5], [50, 2, 50, 3, 57, 2, 57, 3, 57, 4, 57, 5], [48, 2, 48, 3, 59, 2, 59, 3, 59, 4, 59, 5], [7, 3, 7, 4, 6, 3, 6, 4, 6, 5, 6, 6], [19, 3, 19, 4, 18, 3, 18, 4, 18, 5, 18, 6], [31, 3, 31, 4, 30, 3, 30, 4, 30, 5, 30, 6], [43, 3, 43, 4, 42, 3, 42, 4, 42, 5, 42, 6], [55, 3, 55, 4, 54, 3, 54, 4, 54, 5, 54, 6], [12, 4, 12, 5, 11, 4, 11, 5], [14, 4, 14, 5, 9, 4, 9, 5], [16, 4, 16, 5, 7, 4, 7, 5], [18, 4, 18, 5, 17, 4, 17, 5], [20, 4, 20, 5, 15, 4, 15, 5], [22, 4, 22, 5, 13, 4, 13, 5], [24, 4, 24, 5, 23, 4, 23, 5], [26, 4, 26, 5, 21, 4, 21, 5], [28, 4, 28, 5, 19, 4, 19, 5], [30, 4, 30, 5, 29, 4, 29, 5], [32, 4, 32, 5, 27, 4, 27, 5], [34, 4, 34, 5, 25, 4, 25, 5], [36, 4, 36, 5, 35, 4, 35, 5], [38, 4, 38, 5, 33, 4, 33, 5], [40, 4, 40, 5, 31, 4, 31, 5], [42, 4, 42, 5, 41, 4, 41, 5], [44, 4, 44, 5, 39, 4, 39, 5], [46, 4, 46, 5, 37, 4, 37, 5], [48, 4, 48, 5, 47, 4, 47, 5], [50, 4, 50, 5, 45, 4, 45, 5], [52, 4, 52, 5, 43, 4, 43, 5], [0, 4, 0, 5, 0, 2, 0, 3, 11, 2, 11, 3], [10, 4, 10, 5, 1, 4, 1, 5, 1, 6, 1, 7], [2, 4, 2, 5, 2, 2, 2, 3, 9, 2, 9, 3], [8, 4, 8, 5, 3, 4, 3, 5, 3, 6, 3, 7], [4, 4, 4, 5, 4, 2, 4, 3, 7, 2, 7, 3], [6, 4, 6, 5, 5, 4, 5, 5, 5, 6, 5, 7], [3, 5, 3, 6, 2, 5, 2, 6], [7, 5, 7, 6, 8, 5, 8, 6], [9, 5, 9, 6, 10, 5, 10, 6], [15, 5, 15, 6, 14, 5, 14, 6], [19, 5, 19, 6, 20, 5, 20, 6], [21, 5, 21, 6, 22, 5, 22, 6], [27, 5, 27, 6, 26, 5, 26, 6], [31, 5, 31, 6, 32, 5, 32, 6], [33, 5, 33, 6, 34, 5, 34, 6], [39, 5, 39, 6, 38, 5, 38, 6], [43, 5, 43, 6, 44, 5, 44, 6], [45, 5, 45, 6, 46, 5, 46, 6], [51, 5, 51, 6, 50, 5, 50, 6], [55, 5, 55, 6, 56, 5, 56, 6], [57, 5, 57, 6, 58, 5, 58, 6], [1, 5, 1, 6, 0, 5, 0, 6, 0, 7, 0, 8], [11, 5, 11, 6, 11, 3, 11, 4, 10, 3, 10, 4], [13, 5, 13, 6, 12, 5, 12, 6, 12, 7, 12, 8], [23, 5, 23, 6, 23, 3, 23, 4, 22, 3, 22, 4], [25, 5, 25, 6, 24, 5, 24, 6, 24, 7, 24, 8], [35, 5, 35, 6, 35, 3, 35, 4, 34, 3, 34, 4], [37, 5, 37, 6, 36, 5, 36, 6, 36, 7, 36, 8], [47, 5, 47, 6, 47, 3, 47, 4, 46, 3, 46, 4], [49, 5, 49, 6, 48, 5, 48, 6, 48, 7, 48, 8], [59, 5, 59, 6, 59, 3, 59, 4, 58, 3, 58, 4], [6, 6, 6, 7, 17, 6, 17, 7], [8, 6, 8, 7, 15, 6, 15, 7], [10, 6, 10, 7, 13, 6, 13, 7], [12, 6, 12, 7, 23, 6, 23, 7], [14, 6, 14, 7, 21, 6, 21, 7], [16, 6, 16, 7, 19, 6, 19, 7], [18, 6, 18, 7, 29, 6, 29, 7], [20, 6, 20, 7, 27, 6, 27, 7], [22, 6, 22, 7, 25, 6, 25, 7], [24, 6, 24, 7, 35, 6, 35, 7], [26, 6, 26, 7, 33, 6, 33, 7], [28, 6, 28, 7, 31, 6, 31, 7], [30, 6, 30, 7, 41, 6, 41, 7], [32, 6, 32, 7, 39, 6, 39, 7], [34, 6, 34, 7, 37, 6, 37, 7], [36, 6, 36, 7, 47, 6, 47, 7], [38, 6, 38, 7, 45, 6, 45, 7], [40, 6, 40, 7, 43, 6, 43, 7], [42, 6, 42, 7, 53, 6, 53, 7], [44, 6, 44, 7, 51, 6, 51, 7], [46, 6, 46, 7, 49, 6, 49, 7], [54, 6, 54, 7, 54, 4, 54, 5, 53, 4, 53, 5], [56, 6, 56, 7, 56, 4, 56, 5, 51, 4, 51, 5], [58, 6, 58, 7, 58, 4, 58, 5, 49, 4, 49, 5], [1, 7, 1, 8, 2, 7, 2, 8], [3, 7, 3, 8, 4, 7, 4, 8], [9, 7, 9, 8, 8, 7, 8, 8], [13, 7, 13, 8, 14, 7, 14, 8], [15, 7, 15, 8, 16, 7, 16, 8], [21, 7, 21, 8, 20, 7, 20, 8], [25, 7, 25, 8, 26, 7, 26, 8], [27, 7, 27, 8, 28, 7, 28, 8], [33, 7, 33, 8, 32, 7, 32, 8], [37, 7, 37, 8, 38, 7, 38, 8], [39, 7, 39, 8, 40, 7, 40, 8], [45, 7, 45, 8, 44, 7, 44, 8], [49, 7, 49, 8, 50, 7, 50, 8], [51, 7, 51, 8, 52, 7, 52, 8], [57, 7, 57, 8, 56, 7, 56, 8], [5, 7, 5, 8, 5, 5, 5, 6, 4, 5, 4, 6], [17, 7, 17, 8, 17, 5, 17, 6, 16, 5, 16, 6], [29, 7, 29, 8, 29, 5, 29, 6, 28, 5, 28, 6], [41, 7, 41, 8, 41, 5, 41, 6, 40, 5, 40, 6], [53, 7, 53, 8, 53, 5, 53, 6, 52, 5, 52, 6]

TABLE 25B

[52, 6, 52, 7, 55, 6, 55, 7, 55, 8, 0, 0], [50, 6, 50, 7, 57, 6, 57, 7, 57, 8, 0, 0], [48, 6, 48, 7, 59, 6, 59, 7, 59, 8, 0, 0],
[7, 7, 7, 8, 6, 7, 6, 8],
[11, 7, 11, 8, 10, 7, 10, 8], [19, 7, 19, 8, 18, 7, 18, 8], [23, 7, 23, 8, 22, 7, 22, 8], [31, 7, 31, 8, 30, 7, 30, 8], [35, 7, 35, 8, 34, 7, 34, 8],
[43, 7, 43, 8, 42, 7, 42, 8], [47, 7, 47, 8, 46, 7, 46, 8], [55, 7, 55, 8, 54, 7, 54, 8], [59, 7, 59, 8, 58, 7, 58, 8], [6, 8, 0, 0, 5, 8, 0, 0], [8, 8,
0, 0, 3, 8, 0, 0], [10, 8, 0, 0, 1, 8, 0, 0], [12, 8, 0, 0, 11, 8, 0, 0], [14, 8, 0, 0, 9, 8, 0, 0], [16, 8, 0, 0, 7, 8, 0, 0], [18, 8, 0, 0, 17, 8, 0, 0],
[20, 8, 0, 0, 15, 8, 0, 0], [22, 8, 0, 0, 13, 8, 0, 0], [24, 8, 0, 0, 23, 8, 0, 0], [26, 8, 0, 0, 21, 8, 0, 0], [28, 8, 0, 0, 19, 8, 0, 0], [30, 8, 0, 0,
29, 8, 0, 0], [32, 8, 0, 0, 27, 8, 0, 0], [34, 8, 0, 0, 25, 8, 0, 0], [36, 8, 0, 0, 35, 8, 0, 0], [38, 8, 0, 0, 33, 8, 0, 0], [40, 8, 0, 0, 31, 8, 0, 0],
[42, 8, 0, 0, 41, 8, 0, 0], [44, 8, 0, 0, 39, 8, 0, 0], [46, 8, 0, 0, 37, 8, 0, 0], [48, 8, 0, 0, 47, 8, 0, 0], [50, 8, 0, 0, 45, 8, 0, 0], [52, 8, 0, 0,
43, 8, 0, 0], [54, 8, 0, 0, 53, 8, 0, 0], [56, 8, 0, 0, 51, 8, 0, 0], [58, 8, 0, 0, 49, 8, 0, 0], [0, 8, 0, 0, 0, 6, 0, 7, 11, 6, 11, 7],
[2, 8, 0, 0, 2, 6, 2, 7, 9, 6, 9, 7], [4, 8, 0, 0, 4, 6, 4, 7, 7, 6, 7, 7]

The core oligonucleotide sequences used to produce 6H×10H×128B nucleic acid structures of the invention are designated SEQ ID NOs. 4291-4706, and the corresponding voxel coordinates are shown respectively in Table 26A. The end oligonucleotide sequences used to produce 6H×10H×128B nucleic acid structures of the invention are designated SEQ ID NOs. 4793-4835, and the corresponding voxel coordinates are shown respectively in Table 26B. (See also Appendix, Table 10 of U.S. provisional application No. 61/675,309, filed Jul. 24, 2012, incorporated by reference herein.)

TABLE 26A

[53, 7, 53, 8, 53, 5, 53, 6, 52, 5, 52, 6], [52, 6, 52, 7, 55, 6, 55, 7, 55, 8, 55, 9], [50, 6, 50, 7, 57, 6, 57, 7, 57, 8, 57, 9], [48, 6, 48, 7, 59,
6, 59, 7, 59, 8, 59, 9], [7, 7, 7, 8, 6, 7, 6, 8, 6, 9, 6, 10], [19, 7, 19, 8, 18, 7, 18, 8, 18, 9, 18, 10], [31, 7, 31, 8, 30, 7, 30, 8, 30, 9, 30,
10], [43, 7, 43, 8, 42, 7, 42, 8, 42, 9, 42, 10], [55, 7, 55, 8, 54, 7, 54, 8, 54, 9, 54, 10], [12, 8, 12, 9, 11, 8, 11, 9], [14, 8, 14, 9, 9, 8, 9,
9], [16, 8, 16, 9, 7, 8, 7, 9], [18, 8, 18, 9, 17, 8, 17, 9], [20, 8, 20, 9, 15, 8, 15, 9], [22, 8, 22, 9, 13, 8, 13, 9], [24, 8, 24, 9, 23, 8, 23, 9],
[26, 8, 26, 9, 21, 8, 21, 9], [28, 8, 28, 9, 19, 8, 19, 9], [30, 8, 30, 9, 29, 8, 29, 9], [32, 8, 32, 9, 27, 8, 27, 9], [34, 8, 34, 9, 25, 8, 25, 9],
[36, 8, 36, 9, 35, 8, 35, 9], [38, 8, 38, 9, 33, 8, 33, 9], [40, 8, 40, 9, 31, 8, 31, 9], [42, 8, 42, 9, 41, 8, 41, 9], [44, 8, 44, 9, 39, 8, 39, 9],
[46, 8, 46, 9, 37, 8, 37, 9], [48, 8, 48, 9, 47, 8, 47, 9], [50, 8, 50, 9, 45, 8, 45, 9], [52, 8, 52, 9, 43, 8, 43, 9], [0, 8, 0, 9, 0, 6, 0, 7, 11, 6,
11, 7], [10, 8, 10, 9, 1, 8, 1, 9, 1, 10, 1, 11], [2, 8, 2, 9, 2, 6, 2, 7, 9, 6, 9, 7], [8, 8, 8, 9, 3, 8, 3, 9, 3, 10, 3, 11], [4, 8, 4, 9, 4, 6, 4, 7, 7, 6,
7, 7], [6, 8, 6, 9, 5, 8, 5, 9, 5, 10, 5, 11], [3, 9, 3, 10, 2, 9, 2, 10], [7, 9, 7, 10, 8, 9, 8, 10], [9, 9, 9, 10, 10, 9, 10, 10], [15, 9, 15, 10, 14,
9, 14, 10], [19, 9, 19, 10, 20, 9, 20, 10], [21, 9, 21, 10, 22, 9, 22, 10], [27, 9, 27, 10, 26, 9, 26, 10], [31, 9, 31, 10, 32, 9, 32, 10], [33, 9,
33, 10, 34, 9, 34, 10], [39, 9, 39, 10, 38, 9, 38, 10], [43, 9, 43, 10, 44, 9, 44, 10], [45, 9, 45, 10, 46, 9, 46, 10], [51, 9, 51, 10, 50, 9, 50,
10], [55, 9, 55, 10, 56, 9, 56, 10], [57, 9, 57, 10, 58, 9, 58, 10], [1, 9, 1, 10, 0, 9, 0, 10, 0, 11, 0, 12], [11, 9, 11, 10, 11, 7, 11, 8, 10, 7,
10, 8], [13, 9, 13, 10, 12, 9, 12, 10, 12, 11, 12, 12], [23, 9, 23, 10, 23, 7, 23, 8, 22, 7, 22, 8], [25, 9, 25, 10, 24, 9, 24, 10, 24, 11, 24,
12], [35, 9, 35, 10, 35, 7, 35, 8, 34, 7, 34, 8], [37, 9, 37, 10, 36, 9, 36, 10, 36, 11, 36, 12], [47, 9, 47, 10, 47, 7, 47, 8, 46, 7, 46, 8], [49,
9, 49, 10, 48, 9, 48, 10, 48, 11, 48, 12], [59, 9, 59, 10, 59, 7, 59, 8, 58, 7, 58, 8], [6, 10, 6, 11, 17, 10, 17, 11], [8, 10, 8, 11, 15, 10, 15,
11], [10, 10, 10, 11, 13, 10, 13, 11], [12, 10, 12, 11, 23, 10, 23, 11], [14, 10, 14, 11, 21, 10, 21, 11], [16, 10, 16, 11, 19, 10, 19, 11],
[18, 10, 18, 11, 29, 10, 29, 11], [20, 10, 20, 11, 27, 10, 27, 11], [22, 10, 22, 11, 25, 10, 25, 11], [24, 10, 24, 11, 35, 10, 35, 11], [26, 10,
26, 11, 33, 10, 33, 11], [28, 10, 28, 11, 31, 10, 31, 11], [30, 10, 30, 11, 41, 10, 41, 11], [32, 10, 32, 11, 39, 10, 39, 11], [34, 10, 34, 11,
37, 10, 37, 11], [36, 10, 36, 11, 47, 10, 47, 11], [38, 10, 38, 11, 45, 10, 45, 11], [40, 10, 40, 11, 43, 10, 43, 11], [42, 10, 42, 11, 53, 10,
53, 11], [44, 10, 44, 11, 51, 10, 51, 11], [46, 10, 46, 11, 49, 10, 49, 11], [54, 10, 54, 11, 54, 8, 54, 9, 53, 8, 53, 9], [52, 10, 52, 11, 55,
10, 55, 11, 55, 12, 55, 13], [56, 10, 56, 11, 56, 8, 56, 9, 51, 8, 51, 9], [50, 10, 50, 11, 57, 10, 57, 11, 57, 12, 57, 13], [58, 10, 58, 11, 58,
8, 58, 9, 49, 8, 49, 9], [48, 10, 48, 11, 59, 10, 59, 11, 59, 12, 59, 13], [1, 11, 1, 12, 2, 11, 2, 12], [3, 11, 3, 12, 4, 11, 4, 12], [9, 11, 9, 12,
8, 11, 8, 12], [13, 11, 13, 12, 14, 11, 14, 12], [15, 11, 15, 12, 16, 11, 16, 12], [21, 11, 21, 12, 20, 11, 20, 12], [25, 11, 25, 12, 26, 11, 26,
12], [27, 11, 27, 12, 28, 11, 28, 12], [33, 11, 33, 12, 32, 11, 32, 12], [37, 11, 37, 12, 38, 11, 38, 12], [39, 11, 39, 12, 40, 11, 40, 12],
[45, 11, 45, 12, 44, 11, 44, 12], [49, 11, 49, 12, 50, 11, 50, 12], [51, 11, 51, 12, 52, 11, 52, 12], [57, 11, 57, 12, 56, 11, 56, 12], [5, 11,
5, 12, 5, 9, 5, 10, 4, 9, 4, 10], [7, 11, 7, 12, 6, 11, 6, 12, 6, 13, 6, 14], [17, 11, 17, 12, 17, 9, 17, 10, 16, 9, 16, 10], [19, 11, 19, 12, 18,
11, 18, 12, 18, 13, 18, 14], [29, 11, 29, 12, 29, 9, 29, 10, 28, 9, 28, 10], [31, 11, 31, 12, 30, 11, 30, 12, 30, 13, 30, 14], [41, 11, 41, 12,
41, 9, 41, 10, 40, 9, 40, 10], [43, 11, 43, 12, 42, 11, 42, 12, 42, 13, 42, 14], [53, 11, 53, 12, 53, 9, 53, 10, 52, 9, 52, 10], [55, 11, 55, 12,
54, 11, 54, 12, 54, 13, 54, 14], [12, 12, 12, 13, 11, 12, 11, 13], [14, 12, 14, 13, 9, 12, 9, 13], [16, 12, 16, 13, 7, 12, 7, 13], [18, 12, 18,
13, 17, 12, 17, 13], [20, 12, 20, 13, 15, 12, 15, 13], [22, 12, 22, 13, 13, 12, 13, 13], [24, 12, 24, 13, 23, 12, 23, 13], [26, 12, 26, 13, 21,
12, 21, 13], [28, 12, 28, 13, 19, 12, 19, 13], [30, 12, 30, 13, 29, 12, 29, 13], [32, 12, 32, 13, 27, 12, 27, 13], [34, 12, 34, 13, 25, 12, 25,
13], [36, 12, 36, 13, 35, 12, 35, 13], [38, 12, 38, 13, 33, 12, 33, 13], [40, 12, 40, 13, 31, 12, 31, 13], [42, 12, 42, 13, 41, 12, 41, 13],
[44, 12, 44, 13, 39, 12, 39, 13], [46, 12, 46, 13, 37, 12, 37, 13], [48, 12, 48, 13, 47, 12, 47, 13], [50, 12, 50, 13, 45, 12, 45, 13], [52, 12,
52, 13, 43, 12, 43, 13], [0, 12, 0, 13, 0, 10, 0, 11, 11, 10, 11, 11], [10, 12, 10, 13, 1, 12, 1, 13, 1, 14, 1, 15], [2, 12, 2, 13, 2, 10, 2, 11, 9,
10, 9, 11], [8, 12, 8, 13, 3, 12, 3, 13, 3, 14, 3, 15], [4, 12, 4, 13, 4, 10, 4, 11, 7, 10, 7, 11], [6, 12, 6, 13, 5, 12, 5, 13, 5, 14, 5, 15], [3, 13,
3, 14, 2, 13, 2, 14], [7, 13, 7, 14, 8, 13, 8, 14], [9, 13, 9, 14, 10, 13, 10, 14], [15, 13, 15, 14, 14, 13, 14, 14], [19, 13, 19, 14, 20, 13, 20,
14], [21, 13, 21, 14, 22, 13, 22, 14], [27, 13, 27, 14, 26, 13, 26, 14], [31, 13, 31, 14, 32, 13, 32, 14], [33, 13, 33, 14, 34, 13, 34, 14],
[39, 13, 39, 14, 38, 13, 38, 14], [43, 13, 43, 14, 44, 13, 44, 14], [45, 13, 45, 14, 46, 13, 46, 14], [51, 13, 51, 14, 50, 13, 50, 14], [55, 13,
55, 14, 56, 13, 56, 14], [57, 13, 57, 14, 58, 13, 58, 14], [1, 13, 1, 14, 0, 13, 0, 14, 0, 15, 0, 16], [11, 13, 11, 14, 11, 11, 11, 12, 10, 11,
10, 12], [13, 13, 13, 14, 12, 13, 12, 14, 12, 15, 12, 16], [23, 13, 23, 14, 23, 11, 23, 12, 22, 11, 22, 12], [25, 13, 25, 14, 24, 13, 24, 14,
24, 15, 24, 16], [35, 13, 35, 14, 35, 11, 35, 12, 34, 11, 34, 12], [37, 13, 37, 14, 36, 13, 36, 14, 36, 15, 36, 16], [47, 13, 47, 14, 47, 11,
47, 12, 46, 11, 46, 12], [49, 13, 49, 14, 48, 13, 48, 14, 48, 15, 48, 16], [59, 13, 59, 14, 59, 11, 59, 12, 58, 11, 58, 12], [6, 14, 6, 15, 17,
14, 17, 15], [8, 14, 8, 15, 15, 14, 15, 15], [10, 14, 10, 15, 13, 14, 13, 15], [12, 14, 12, 15, 23, 14, 23, 15], [14, 14, 14, 15, 21, 14, 21,
15], [16, 14, 16, 15, 19, 14, 19, 15], [18, 14, 18, 15, 29, 14, 29, 15], [20, 14, 20, 15, 27, 14, 27, 15], [22, 14, 22, 15, 25, 14, 25, 15],
[24, 14, 24, 15, 35, 14, 35, 15], [26, 14, 26, 15, 33, 14, 33, 15], [28, 14, 28, 15, 31, 14, 31, 15], [30, 14, 30, 15, 41, 14, 41, 15], [32, 14,
32, 15, 39, 14, 39, 15], [34, 14, 34, 15, 37, 14, 37, 15], [36, 14, 36, 15, 47, 14, 47, 15], [38, 14, 38, 15, 45, 14, 45, 15], [40, 14, 40, 15,
43, 14, 43, 15], [42, 14, 42, 15, 53, 14, 53, 15], [44, 14, 44, 15, 51, 14, 51, 15], [46, 14, 46, 15, 49, 14, 49, 15], [54, 14, 54, 15, 54, 12,
54, 13, 53, 12, 53, 13], [56, 14, 56, 15, 56, 12, 56, 13, 51, 12, 51, 13], [58, 14, 58, 15, 58, 12, 58, 13, 49, 12, 49, 13], [1, 15, 1, 16, 2,
15, 2, 16], [3, 15, 3, 16, 4, 15, 4, 16], [9, 15, 9, 16, 8, 15, 8, 16], [15, 15, 15, 16, 14, 15, 14, 16], [15, 15, 15, 16, 14, 15, 14, 16], [21,
15, 21, 16, 20, 15, 20, 16], [25, 15, 25, 16, 26, 15, 26, 16], [27, 15, 27, 16, 28, 15, 28, 16], [33, 15, 33, 16, 32, 15, 32, 16], [37, 15, 37,
16, 38, 15, 38, 16], [39, 15, 39, 16, 40, 15, 40, 16], [45, 15, 45, 16, 44, 15, 44, 16], [49, 15, 49, 16, 50, 15, 50, 16], [51, 15, 51, 16, 52,
15, 52, 16], [57, 15, 57, 16, 56, 15, 56, 16], [5, 15, 5, 16, 5, 13, 5, 14, 4, 13, 4, 14], [17, 15, 17, 16, 17, 13, 17, 14, 16, 13, 16, 14], [29,
15, 29, 16, 29, 13, 29, 14, 28, 13, 28, 14], [41, 15, 41, 16, 41, 13, 41, 14, 40, 13, 40, 14], [53, 15, 53, 16, 53, 13, 53, 14, 52, 13, 52, 14]

TABLE 26B

[52, 14, 52, 15, 55, 14, 55, 15, 55, 16, 0, 0], [50, 14, 50, 15, 57, 14, 57, 15, 57, 16, 0, 0], [48, 14, 48, 15, 59, 14, 59, 15, 59, 16, 0, 0], [7, 15, 7, 16, 6, 15, 6, 16], [11, 15, 11, 16, 10, 15, 10, 16], [19, 15, 19, 16, 18, 15, 18, 16], [23, 15, 23, 16, 22, 15, 22, 16], [31, 15, 31, 16, 30, 15, 30, 16], [35, 15, 35, 16, 34, 15, 34, 16], [43, 15, 43, 16, 42, 15, 42, 16], [47, 15, 47, 16, 46, 15, 46, 16], [55, 15, 55, 16, 54, 15, 54, 16], [59, 15, 59, 16, 58, 15, 58, 16], [6, 16, 0, 0, 5, 16, 0, 0], [8, 16, 0, 0, 3, 16, 0, 0], [10, 16, 0, 0, 1, 16, 0, 0], [12, 16, 0, 0, 11, 16, 0, 0], [14, 16, 0, 0, 9, 16, 0, 0], [16, 16, 0, 0, 7, 16, 0, 0], [18, 16, 0, 0, 17, 16, 0, 0], [20, 16, 0, 0, 15, 16, 0, 0], [22, 16, 0, 0, 13, 16, 0, 0], [24, 16, 0, 0, 23, 16, 0, 0], [26, 16, 0, 0, 21, 16, 0, 0], [28, 16, 0, 0, 19, 16, 0, 0], [30, 16, 0, 0, 29, 16, 0, 0], [32, 16, 0, 0, 27, 16, 0, 0], [34, 16, 0, 0, 25, 16, 0, 0], [36, 16, 0, 0, 35, 16, 0, 0], [38, 16, 0, 0, 33, 16, 0, 0], [40, 16, 0, 0, 31, 16, 0, 0], [42, 16, 0, 0, 41, 16, 0, 0], [44, 16, 0, 0, 39, 16, 0, 0], [46, 16, 0, 0, 37, 16, 0, 0], [48, 16, 0, 0, 47, 16, 0, 0], [50, 16, 0, 0, 45, 16, 0, 0], [52, 16, 0, 0, 43, 16, 0, 0], [54, 16, 0, 0, 53, 16, 0, 0], [56, 16, 0, 0, 51, 16, 0, 0], [58, 16, 0, 0, 49, 16, 0, 0], [0, 16, 0, 0, 0, 14, 0, 15, 11, 14, 11, 15], [2, 16, 0, 0, 2, 14, 2, 15, 9, 14, 9, 15], [4, 16, 0, 0, 4, 14, 4, 15, 7, 14, 7, 15]

The core oligonucleotide sequences used to produce 8H×12H×32B nucleic acid structures of the invention are designated SEQ ID NOs. 4836-5007, and the corresponding voxel coordinates are shown respectively in Table 27A. The end oligonucleotide sequences used to produce 8H×12H×32B nucleic acid structures of the invention are designated SEQ ID NOs. 5482-5545, and the corresponding voxel coordinates are shown respectively in Table 27B. (See also Appendix, Table 11 of U.S. provisional application No. 61/675,309, filed Jul. 24, 2012, incorporated by reference herein.)

TABLE 27A

[0, 0, 0, 1, 0, 0, 0, 0], [0, 0, 2, 1, 0, 0, 0, 0], [0, 0, 4, 1, 0, 0, 0, 0], [0, 0, 6, 1, 0, 0, 0, 0], [0, 0, 89, 1, 0, 0, 0, 0], [0, 0, 91, 1, 0, 0, 0, 0], [0, 0, 93, 1, 0, 0, 0, 0], [0, 0, 95, 1, 0, 0, 0, 0], [0, 0, 16, 1, 0, 0, 15, 1], [0, 0, 18, 1, 0, 0, 13, 1], [0, 0, 20, 1, 0, 0, 11, 1], [0, 0, 22, 1, 0, 0, 9, 1], [0, 0, 24, 1, 0, 0, 23, 1], [0, 0, 26, 1, 0, 0, 21, 1], [0, 0, 28, 1, 0, 0, 19, 1], [0, 0, 30, 1, 0, 0, 17, 1], [0, 0, 32, 1, 0, 0, 31, 1], [0, 0, 34, 1, 0, 0, 29, 1], [0, 0, 36, 1, 0, 0, 27, 1], [0, 0, 38, 1, 0, 0, 25, 1], [0, 0, 40, 1, 0, 0, 39, 1], [0, 0, 42, 1, 0, 0, 37, 1], [0, 0, 44, 1, 0, 0, 35, 1], [0, 0, 46, 1, 0, 0, 33, 1], [0, 0, 48, 1, 0, 0, 47, 1], [0, 0, 50, 1, 0, 0, 45, 1], [0, 0, 52, 1, 0, 0, 43, 1], [0, 0, 54, 1, 0, 0, 41, 1], [0, 0, 56, 1, 0, 0, 55, 1], [0, 0, 58, 1, 0, 0, 53, 1], [0, 0, 60, 1, 0, 0, 51, 1], [0, 0, 62, 1, 0, 0, 49, 1], [0, 0, 64, 1, 0, 0, 63, 1], [0, 0, 66, 1, 0, 0, 61, 1], [0, 0, 68, 1, 0, 0, 59, 1], [0, 0, 70, 1, 0, 0, 57, 1], [0, 0, 72, 1, 0, 0, 71, 1], [0, 0, 74, 1, 0, 0, 69, 1], [0, 0, 76, 1, 0, 0, 67, 1], [0, 0, 78, 1, 0, 0, 65, 1], [0, 0, 80, 1, 0, 0, 79, 1], [0, 0, 82, 1, 0, 0, 77, 1], [0, 0, 84, 1, 0, 0, 75, 1], [0, 0, 86, 1, 0, 0, 73, 1], [0, 0, 14, 1, 0, 0, 1, 1, 1, 2, 1, 3], [0, 0, 12, 1, 0, 0, 3, 1, 3, 2, 3, 3], [0, 0, 10, 1, 0, 0, 5, 1, 5, 2, 5, 3], [0, 0, 8, 1, 0, 0, 7, 1, 7, 2, 7, 3], [8, 1, 8, 2, 0, 0, 0, 0], [15, 1, 15, 2, 0, 0, 0, 0], [24, 1, 24, 2, 0, 0, 0, 0], [31, 1, 31, 2, 0, 0, 0, 0], [40, 1, 40, 2, 0, 0, 0, 0], [47, 1, 47, 2, 0, 0, 0, 0], [56, 1, 56, 2, 0, 0, 0, 0], [63, 1, 63, 2, 0, 0, 0, 0], [72, 1, 72, 2, 0, 0, 0, 0], [79, 1, 79, 2, 0, 0, 0, 0], [88, 1, 88, 2, 0, 0, 0, 0], [95, 1, 95, 2, 0, 0, 0, 0], [3, 1, 3, 2, 2, 1, 2, 2], [5, 1, 5, 2, 4, 1, 4, 2], [9, 1, 9, 2, 10, 1, 10, 2], [11, 1, 11, 2, 12, 1, 12, 2], [13, 1, 13, 2, 14, 1, 14, 2], [19, 1, 19, 2, 18, 1, 18, 2], [21, 1, 21, 2, 20, 1, 20, 2], [25, 1, 25, 2, 26, 1, 26, 2], [27, 1, 27, 2, 28, 1, 28, 2], [29, 1, 29, 2, 30, 1, 30, 2], [35, 1, 35, 2, 34, 1, 34, 2], [37, 1, 37, 2, 36, 1, 36, 2], [41, 1, 41, 2, 42, 1, 42, 2], [43, 1, 43, 2, 44, 1, 44, 2], [45, 1, 45, 2, 46, 1, 46, 2], [51, 1, 51, 2, 50, 1, 50, 2], [53, 1, 53, 2, 52, 1, 52, 2], [57, 1, 57, 2, 58, 1, 58, 2], [59, 1, 59, 2, 60, 1, 60, 2], [61, 1, 61, 2, 62, 1, 62, 2], [67, 1, 67, 2, 66, 1, 66, 2], [69, 1, 69, 2, 68, 1, 68, 2], [73, 1, 73, 2, 74, 1, 74, 2], [75, 1, 75, 2, 76, 1, 76, 2], [77, 1, 77, 2, 78, 1, 78, 2], [83, 1, 83, 2, 82, 1, 82, 2], [85, 1, 85, 2, 84, 1, 84, 2], [89, 1, 89, 2, 90, 1, 90, 2], [91, 1, 91, 2, 92, 1, 92, 2], [93, 1, 93, 2, 94, 1, 94, 2], [1, 1, 1, 2, 0, 1, 0, 2, 0, 3, 0, 4], [17, 1, 17, 2, 16, 1, 16, 2, 16, 3, 16, 4], [33, 1, 33, 2, 32, 1, 32, 2, 32, 3, 32, 4], [49, 1, 49, 2, 48, 1, 48, 2, 48, 3, 48, 4], [65, 1, 65, 2, 64, 1, 64, 2, 64, 3, 64, 4], [81, 1, 81, 2, 80, 1, 80, 2, 80, 3, 80, 4], [8, 2, 8, 3, 23, 2, 23, 3], [10, 2, 10, 3, 21, 2, 21, 3], [12, 2, 12, 3, 19, 2, 19, 3], [14, 2, 14, 3, 17, 2, 17, 3], [16, 2, 16, 3, 31, 2, 31, 3], [18, 2, 18, 3, 29, 2, 29, 3], [20, 2, 20, 3, 27, 2, 27, 3], [22, 2, 22, 3, 25, 2, 25, 3], [24, 2, 24, 3, 39, 2, 39, 3], [26, 2, 26, 3, 37, 2, 37, 3], [28, 2, 28, 3, 35, 2, 35, 3], [30, 2, 30, 3, 33, 2, 33, 3], [32, 2, 32, 3, 47, 2, 47, 3], [34, 2, 34, 3, 45, 2, 45, 3], [36, 2, 36, 3, 43, 2, 43, 3], [38, 2, 38, 3, 41, 2, 41, 3], [40, 2, 40, 3, 55, 2, 55, 3], [42, 2, 42, 3, 53, 2, 53, 3], [44, 2, 44, 3, 51, 2, 51, 3], [46, 2, 46, 3, 49, 2, 49, 3], [50, 2, 50, 3, 61, 2, 61, 3], [52, 2, 52, 3, 59, 2, 59, 3], [54, 2, 54, 3, 57, 2, 57, 3], [56, 2, 56, 3, 71, 2, 71, 3], [58, 2, 58, 3, 69, 2, 69, 3], [60, 2, 60, 3, 67, 2, 67, 3], [62, 2, 62, 3, 65, 2, 65, 3], [64, 2, 64, 3, 79, 2, 79, 3], [66, 2, 66, 3, 77, 2, 77, 3], [68, 2, 68, 3, 75, 2, 75, 3], [70, 2, 70, 3, 73, 2, 73, 3], [72, 2, 72, 3, 87, 2, 87, 3], [74, 2, 74, 3, 85, 2, 85, 3], [76, 2, 76, 3, 83, 2, 83, 3], [78, 2, 78, 3, 81, 2, 81, 3], [88, 2, 88, 3, 0, 0, 88, 1, 0, 0, 87, 1], [90, 2, 90, 3, 0, 0, 90, 1, 0, 0, 85, 1], [92, 2, 92, 3, 0, 0, 92, 1, 0, 0, 83, 1], [94, 2, 94, 3, 0, 0, 94, 1, 0, 0, 81, 1], [1, 3, 1, 4, 2, 3, 2, 4], [3, 3, 3, 4, 4, 3, 4, 4], [5, 3, 5, 4, 6, 3, 6, 4], [11, 3, 11, 4, 10, 3, 10, 4], [13, 3, 13, 4, 12, 3, 12, 4], [17, 3, 17, 4, 18, 3, 18, 4], [19, 3, 19, 4, 20, 3, 20, 4], [21, 3, 21, 4, 22, 3, 22, 4], [27, 3, 27, 4, 26, 3, 26, 4], [29, 3, 29, 4, 28, 3, 28, 4], [33, 3, 33, 4, 34, 3, 34, 4], [35, 3, 35, 4, 36, 3, 36, 4], [37, 3, 37, 4, 38, 3, 38, 4], [43, 3, 43, 4, 42, 3, 42, 4], [45, 3, 45, 4, 44, 3, 44, 4], [49, 3, 49, 4, 50, 3, 50, 4], [51, 3, 51, 4, 52, 3, 52, 4], [53, 3, 53, 4, 54, 3, 54, 4], [59, 3, 59, 4, 58, 3, 58, 4], [61, 3, 61, 4, 60, 3, 60, 4], [65, 3, 65, 4, 66, 3, 66, 4], [67, 3, 67, 4, 68, 3, 68, 4], [69, 3, 69, 4, 70, 3, 70, 4], [75, 3, 75, 4, 74, 3, 74, 4], [77, 3, 77, 4, 76, 3, 76, 4], [81, 3, 81, 4, 82, 3, 82, 4], [83, 3, 83, 4, 84, 3, 84, 4], [85, 3, 85, 4, 86, 3, 86, 4], [91, 3, 91, 4, 90, 3, 90, 4], [93, 3, 93, 4, 92, 3, 92, 4], [7, 3, 7, 4, 7, 1, 7, 2, 6, 1, 6, 2], [23, 3, 23, 4, 23, 1, 23, 2, 22, 1, 22, 2], [39, 3, 39, 4, 39, 1, 39, 2, 38, 1, 38, 2], [55, 3, 55, 4, 55, 1, 55, 2, 54, 1, 54, 2], [71, 3, 71, 4, 71, 1, 71, 2, 70, 1, 70, 2], [87, 3, 87, 4, 87, 1, 87, 2, 86, 1, 86, 2]

TABLE 27B

[86, 2, 86, 3, 89, 2, 89, 3, 89, 4, 0, 0], [84, 2, 84, 3, 91, 2, 91, 3, 91, 4, 0, 0], [82, 2, 82, 3, 93, 2, 93, 3, 93, 4, 0, 0], [80, 2, 80, 3, 95, 2, 95, 3, 95, 4, 0, 0], [9, 3, 9, 4, 8, 3, 8, 4], [15, 3, 15, 4, 14, 3, 14, 4], [25, 3, 25, 4, 24, 3, 24, 4], [31, 3, 31, 4, 30, 3, 30, 4], [41, 3, 41, 4, 40, 3, 40, 4], [47, 3, 47, 4, 46, 3, 46, 4], [57, 3, 57, 4, 56, 3, 56, 4], [63, 3, 63, 4, 62, 3, 62, 4], [73, 3, 73, 4, 72, 3, 72, 4], [79, 3, 79, 4, 78, 3, 78, 4], [89, 3, 89, 4, 88, 3, 88, 4], [95, 3, 95, 4, 94, 3, 94, 4], [8, 4, 0, 0, 7, 4, 0, 0], [10, 4, 0, 0, 5, 4, 0, 0], [12, 4, 0, 0, 3, 4, 0, 0], [14, 4, 0, 0, 1, 4, 0, 0], [16, 4, 0, 0, 15, 4, 0, 0], [18, 4, 0, 0, 13, 4, 0, 0], [20, 4, 0, 0, 11, 4, 0, 0], [22, 4, 0, 0, 9, 4, 0, 0], [24, 4, 0, 0, 23, 4, 0, 0], [26, 4, 0, 0, 21, 4, 0, 0], [28, 4, 0, 0, 19, 4, 0, 0], [30, 4, 0, 0, 17, 4, 0, 0], [32, 4, 0, 0, 31, 4, 0, 0], [34, 4, 0, 0, 29, 4, 0, 0], [36, 4, 0, 0, 27, 4, 0, 0], [38, 4, 0, 0, 25, 4, 0, 0], [40, 4, 0, 0, 39, 4, 0, 0], [42, 4, 0, 0, 37, 4, 0, 0], [44, 4, 0, 0, 35, 4, 0, 0], [46, 4, 0, 0, 33, 4, 0, 0], [48, 4, 0, 0, 47, 4, 0, 0], [50, 4, 0, 0, 45, 4, 0, 0], [52, 4, 0, 0, 43, 4, 0, 0], [54, 4, 0, 0, 41, 4, 0, 0], [56, 4, 0, 0, 55, 4, 0, 0], [58, 4, 0, 0, 53, 4, 0, 0], [60, 4, 0, 0, 51, 4, 0, 0], [62, 4, 0, 0, 49, 4, 0, 0], [64, 4, 0, 0, 63, 4, 0, 0], [66, 4, 0, 0, 61, 4, 0, 0], [68, 4, 0, 0, 59, 4, 0, 0], [70, 4, 0, 0, 57, 4, 0, 0], [72, 4, 0, 0, 71, 4, 0, 0], [74, 4, 0, 0, 69, 4, 0, 0], [76, 4, 0, 0, 67, 4, 0, 0], [78, 4, 0, 0, 65, 4, 0, 0], [80, 4, 0, 0, 79, 4, 0, 0], [82, 4, 0, 0, 77, 4, 0, 0], [84, 4, 0, 0, 75, 4, 0, 0], [86, 4, 0, 0, 73, 4, 0, 0], [88, 4, 0, 0, 87, 4, 0, 0], [90, 4, 0, 0, 85, 4, 0, 0], [92, 4, 0, 0, 83, 4, 0, 0], [94, 4, 0, 0, 81, 4, 0, 0], [0, 4, 0, 0, 0, 2, 0, 3, 15, 2, 15, 3], [2, 4, 0, 0, 2, 2, 2, 3, 13, 2, 13, 3], [4, 4, 0, 0, 4, 2, 4, 3, 11, 2, 11, 3], [6, 4, 0, 0, 6, 2, 6, 3, 9, 2, 9, 3]

The core oligonucleotide sequences used to produce 8H×12H×64B nucleic acid structures of the invention are designated SEQ ID NOs. 4836-5179, and the corresponding voxel coordinates are shown respectively in Table 28A. The end oligonucleotide sequences used to produce 8H×12H×64B nucleic acid structures of the invention are designated SEQ ID NOs. 5546-5609, and the corresponding voxel coordinates are shown respectively in Table 28B. (See also Appendix, Table 11 of U.S. provisional application No. 61/675,309, filed Jul. 24, 2012, incorporated by reference herein.)

TABLE 28A

[0, 0, 0, 1, 0, 0, 0, 0], [0, 0, 2, 1, 0, 0, 0, 0], [0, 0, 4, 1, 0, 0, 0, 0], [0, 0, 6, 1, 0, 0, 0, 0], [0, 0, 89, 1, 0, 0, 0, 0], [0, 0, 91, 1, 0, 0, 0, 0], [0, 0, 93, 1, 0, 0, 0, 0], [0, 0, 95, 1, 0, 0, 0, 0], [0, 0, 16, 1, 0, 0, 15, 1], [0, 0, 18, 1, 0, 0, 13, 1], [0, 0, 20, 1, 0, 0, 11, 1], [0, 0, 22, 1, 0, 0, 9, 1], [0, 0, 24, 1, 0, 0, 23, 1], [0, 0, 26, 1, 0, 0, 21, 1], [0, 0, 28, 1, 0, 0, 19, 1], [0, 0, 30, 1, 0, 0, 17, 1], [0, 0, 32, 1, 0, 0, 31, 1], [0, 0, 34, 1, 0, 0, 29, 1], [0, 0, 36, 1, 0, 0, 27, 1], [0, 0, 38, 1, 0, 0, 25, 1], [0, 0, 40, 1, 0, 0, 39, 1], [0, 0, 42, 1, 0, 0, 37, 1], [0, 0, 44, 1, 0, 0, 35, 1], [0, 0, 46, 1, 0, 0, 33, 1], [0, 0, 48, 1, 0, 0, 47, 1], [0, 0, 50, 1, 0, 0, 45, 1], [0, 0, 52, 1, 0, 0, 43, 1], [0, 0, 54, 1, 0, 0, 41, 1], [0, 0, 56, 1, 0, 0, 55, 1], [0, 0, 58, 1, 0, 0, 53, 1], [0, 0, 60, 1, 0, 0, 51, 1], [0, 0, 62, 1, 0, 0, 49, 1], [0, 0, 64, 1, 0, 0, 63, 1], [0, 0, 66, 1, 0, 0, 61, 1], [0, 0, 68, 1, 0, 0, 59, 1], [0, 0, 70, 1, 0, 0, 57, 1], [0, 0, 72, 1, 0, 0, 71, 1], [0, 0, 74, 1, 0, 0, 69, 1], [0, 0, 76, 1, 0, 0, 67, 1], [0, 0, 78, 1, 0, 0, 65, 1], [0, 0, 80, 1, 0, 0, 79, 1], [0, 0, 82, 1, 0, 0, 77, 1], [0, 0, 84, 1, 0, 0, 75, 1], [0, 0, 86, 1, 0, 0, 73, 1], [0, 0, 14, 1, 0, 0, 1, 1, 1, 2, 1, 3], [0, 0, 12, 1, 0, 0, 3, 1, 3, 2, 3], [0, 0, 10, 1, 0, 0, 5, 1, 5, 2, 5, 3], [0, 0, 8, 1, 0, 0, 7, 1, 7, 2, 7, 3], [8, 1, 8, 2, 0, 0, 0, 0], [15, 1, 15, 2, 0, 0, 0, 0], [24, 1, 24, 2, 0, 0, 0, 0], [31, 1, 31, 2, 0, 0, 0, 0], [40, 1, 40, 2, 0, 0, 0, 0], [47, 1, 47, 2, 0, 0, 0, 0], [56, 1, 56, 2, 0, 0, 0, 0], [63, 1, 63, 2, 0, 0, 0, 0], [72, 1, 72, 2, 0, 0, 0, 0], [79, 1, 79, 2, 0, 0, 0, 0], [88, 1, 88, 2, 0, 0, 0, 0], [95, 1, 95, 2, 0, 0, 0, 0], [3, 1, 3, 2, 1, 2], [5, 1, 5, 2, 4, 1, 4, 2], [9, 1, 9, 2, 10, 1, 10, 2], [11, 1, 11, 2, 12, 1, 12, 2], [13, 1, 13, 2, 14, 1, 14, 2], [19, 1, 19, 2, 18, 1, 18, 2], [21, 1, 21, 2, 20, 1, 20, 2], [25, 1, 25, 2, 26, 1, 26, 2], [27, 1, 27, 2, 28, 1, 28, 2], [29, 1, 29, 2, 30, 1, 30, 2], [35, 1, 35, 2, 34, 1, 34, 2], [37, 1, 37, 2, 36, 1, 36, 2], [41, 1, 41, 2, 42, 1, 42, 2], [43, 1, 43, 2, 44, 1, 44, 2], [45, 1, 45, 2, 46, 1, 46, 2], [51, 1, 51, 2, 50, 1, 50, 2], [53, 1, 53, 2, 52, 1, 52, 2], [57, 1, 57, 2, 58, 1, 58, 2], [59, 1, 59, 2, 60, 1, 60, 2], [61, 1, 61, 2, 62, 1, 62, 2], [67, 1, 67, 2, 66, 1, 66, 2], [69, 1, 69, 2, 68, 1, 68, 2], [73, 1, 73, 2, 74, 1, 74, 2], [75, 1, 75, 2, 76, 1, 76, 2], [77, 1, 77, 2, 78, 1, 78, 2], [83, 1, 83, 2, 82, 1, 82, 2], [85, 1, 85, 2, 84, 1, 84, 2], [89, 1, 89, 2, 90, 1, 90, 2], [91, 1, 91, 2, 92, 1, 92, 2], [93, 1, 93, 2, 94, 1, 94, 2], [1, 1, 1, 2, 0, 1, 0, 2, 0, 3, 0, 4], [17, 1, 17, 2, 16, 1, 16, 2, 16, 3, 16, 4], [33, 1, 33, 2, 32, 1, 32, 2, 32, 3, 32, 4], [49, 1, 49, 2, 48, 1, 48, 2, 48, 3, 48, 4], [65, 1, 65, 2, 64, 1, 64, 2, 64, 3, 64, 4], [81, 1, 81, 2, 80, 1, 80, 2, 80, 3, 80, 4], [8, 2, 8, 3, 23, 2, 23, 3], [10, 2, 10, 3, 21, 2, 21, 3], [12, 2, 12, 3, 19, 2, 19, 3], [14, 2, 14, 3, 17, 2, 17, 3], [16, 2, 16, 3, 31, 2, 31, 3], [18, 2, 18, 3, 29, 2, 29, 3], [20, 2, 20, 3, 27, 2, 27, 3], [22, 2, 22, 3, 25, 2, 25, 3], [24, 2, 24, 3, 39, 2, 39, 3], [26, 2, 26, 3, 37, 2, 37, 3], [28, 2, 28, 3, 35, 2, 35, 3], [30, 2, 30, 3, 33, 2, 33, 3], [32, 2, 32, 3, 47, 2, 47, 3], [34, 2, 34, 3, 45, 2, 45, 3], [36, 2, 36, 3, 43, 2, 43, 3], [38, 2, 38, 3, 41, 2, 41, 3], [40, 2, 40, 3, 55, 2, 55, 3], [42, 2, 42, 3, 53, 2, 53, 3], [44, 2, 44, 3, 51, 2, 51, 3], [46, 2, 46, 3, 49, 2, 49, 3], [48, 2, 48, 3, 63, 2, 63, 3], [50, 2, 50, 3, 61, 2, 61, 3], [52, 2, 52, 3, 59, 2, 59, 3], [54, 2, 54, 3, 57, 2, 57, 3], [56, 2, 56, 3, 71, 2, 71, 3], [58, 2, 58, 3, 69, 2, 69, 3], [60, 2, 60, 3, 67, 2, 67, 3], [62, 2, 62, 3, 65, 2, 65, 3], [64, 2, 64, 3, 79, 2, 79, 3], [66, 2, 66, 3, 77, 2, 77, 3], [68, 2, 68, 3, 75, 2, 75, 3], [70, 2, 70, 3, 73, 2, 73, 3], [72, 2, 72, 3, 87, 2, 87, 3], [74, 2, 74, 3, 85, 2, 85, 3], [76, 2, 76, 3, 83, 2, 83, 3], [78, 2, 78, 3, 81, 2, 81, 3], [88, 2, 88, 3, 0, 0, 88, 1, 0, 0, 87, 1], [90, 2, 90, 3, 0, 0, 90, 1, 0, 0, 85, 1], [92, 2, 92, 3, 0, 0, 92, 1, 0, 0, 83, 1], [94, 2, 94, 3, 0, 0, 94, 1, 0, 0, 81, 1], [1, 3, 1, 4, 2, 3, 2, 4], [3, 3, 3, 4, 4, 3, 4, 4], [5, 3, 5, 4, 6, 3, 6, 4], [11, 3, 11, 4, 10, 3, 10, 4], [13, 3, 13, 4, 12, 3, 12, 4], [17, 3, 17, 4, 18, 3, 18, 4], [19, 3, 19, 4, 20, 3, 20, 4], [21, 3, 21, 4, 22, 3, 22, 4], [27, 3, 27, 4, 26, 3, 26, 4], [29, 3, 29, 4, 28, 3, 28, 4], [33, 3, 33, 4, 34, 3, 34, 4], [35, 3, 35, 4, 36, 3, 36, 4], [37, 3, 37, 4, 38, 3, 38, 4], [43, 3, 43, 4, 42, 3, 42, 4], [45, 3, 45, 4, 44, 3, 44, 4], [49, 3, 49, 4, 50, 3, 50, 4], [51, 3, 51, 4, 52, 3, 52, 4], [53, 3, 53, 4, 54, 3, 54, 4], [59, 3, 59, 4, 58, 3, 58, 4], [61, 3, 61, 4, 60, 3, 60, 4], [65, 3, 65, 4, 66, 3, 66, 4], [67, 3, 67, 4, 68, 3, 68, 4], [69, 3, 69, 4, 70, 3, 70, 4], [75, 3, 75, 4, 74, 3, 74, 4], [77, 3, 77, 4, 76, 3, 76, 4], [81, 3, 81, 4, 82, 3, 82, 4], [83, 3, 83, 4, 84, 3, 84, 4], [85, 3, 85, 4, 86, 3, 86, 4], [91, 3, 91, 4, 90, 3, 90, 4], [93, 3, 93, 4, 92, 3, 92, 4], [7, 3, 7, 4, 7, 1, 7, 2, 6, 1, 6, 2], [23, 3, 23, 4, 23, 1, 23, 2, 22, 1, 22, 2], [39, 3, 39, 4, 39, 1, 39, 2, 38, 1, 38, 2], [55, 3, 55, 4, 55, 1, 55, 2, 54, 1, 54, 2], [71, 3, 71, 4, 71, 1, 71, 2, 70, 1, 70, 2], [87, 3, 87, 4, 87, 1, 87, 2, 86, 1, 86, 2], [86, 2, 86, 3, 89, 2, 89, 3, 89, 4, 89, 5], [84, 2, 84, 3, 91, 2, 91, 3, 91, 4, 91, 5], [82, 2, 82, 3, 93, 2, 93, 3, 93, 4, 93, 5], [80, 2, 80, 3, 95, 2, 95, 3, 95, 4, 95, 5], [9, 3, 9, 4, 8, 3, 8, 4, 8, 5, 8, 6], [25, 3, 25, 4, 24, 3, 24, 4, 24, 5, 24, 6], [41, 3, 41, 4, 40, 3, 40, 4, 40, 5, 40, 6], [57, 3, 57, 4, 56, 3, 56, 4, 56, 5, 56, 6], [73, 3, 73, 4, 72, 3, 72, 4, 72, 5, 72, 6], [89, 3, 89, 4, 88, 3, 88, 4, 88, 5, 88, 6], [16, 4, 16, 5, 15, 4, 15, 5], [18, 4, 18, 5, 13, 4, 13, 5], [20, 4, 20, 5, 11, 4, 11, 5], [22, 4, 22, 5, 9, 4, 9, 5], [24, 4, 24, 5, 23, 4, 23, 5], [26, 4, 26, 5, 21, 4, 21, 5], [28, 4, 28, 5, 19, 4, 19, 5], [30, 4, 30, 5, 17, 4, 17, 5], [32, 4, 32, 5, 31, 4, 31, 5], [34, 4, 34, 5, 29, 4, 29, 5], [36, 4, 36, 5, 27, 4, 27, 5], [38, 4, 38, 5, 25, 4, 25, 5], [40, 4, 40, 5, 39, 4, 39, 5], [42, 4, 42, 5, 37, 4, 37, 5], [44, 4, 44, 5, 35, 4, 35, 5], [46, 4, 46, 5, 33, 4, 33, 5], [48, 4, 48, 5, 47, 4, 47, 5], [50, 4, 50, 5, 45, 4, 45, 5], [52, 4, 52, 5, 43, 4, 43, 5], [54, 4, 54, 5, 41, 4, 41, 5], [56, 4, 56, 5, 55, 4, 55, 5], [58, 4, 58, 5, 53, 4, 53, 5], [60, 4, 60, 5, 51, 4, 51, 5], [62, 4, 62, 5, 49, 4, 49, 5], [64, 4, 64, 5, 63, 4, 63, 5], [66, 4, 66, 5, 61, 4, 61, 5], [68, 4, 68, 5, 59, 4, 59, 5], [70, 4, 70, 5, 57, 4, 57, 5], [72, 4, 72, 5, 71, 4, 71, 5], [74, 4, 74, 5, 69, 4, 69, 5], [76, 4, 76, 5, 67, 4, 67, 5], [78, 4, 78, 5, 65, 4, 65, 5], [80, 4, 80, 5, 79, 4, 79, 5], [82, 4, 82, 5, 77, 4, 77, 5], [84, 4, 84, 5, 75, 4, 75, 5], [86, 4, 86, 5, 73, 4, 73, 5], [0, 4, 0, 5, 0, 2, 0, 3, 15, 2, 15, 3], [14, 4, 14, 5, 1, 4, 1, 5, 1, 6, 1, 7], [2, 4, 2, 5, 2, 2, 2, 3, 13, 2, 13, 3], [12, 4, 12, 5, 3, 4, 3, 5, 3, 6, 3, 7], [4, 4, 4, 5, 4, 2, 4, 3, 11, 2, 11, 3], [10, 4, 10, 5, 5, 4, 5, 5, 5, 6, 5, 7], [6, 4, 6, 5, 6, 2, 6, 3, 9, 2, 9, 3], [8, 4, 8, 5, 7, 4, 7, 5, 7, 6, 7, 7], [3, 5, 3, 6, 2, 5, 2, 6], [5, 5, 5, 6, 4, 5, 4, 6], [9, 5, 9, 6, 10, 5, 10, 6], [11, 5, 11, 6, 12, 5, 12, 6], [13, 5, 13, 6, 14, 5, 14, 6], [19, 5, 19, 6, 18, 5, 18, 6], [21, 5, 21, 6, 20, 5, 20, 6], [25, 5, 25, 6, 26, 5, 26, 6], [27, 5, 27, 6, 28, 5, 28, 6], [29, 5, 29, 6, 30, 5, 30, 6], [35, 5, 35, 6, 34, 5, 34, 6], [37, 5, 37, 6, 36, 5, 36, 6], [41, 5, 41, 6, 42, 5, 42, 6], [43, 5, 43, 6, 44, 5, 44, 6], [45, 5, 45, 6, 46, 5, 46, 6], [51, 5, 51, 6, 50, 5, 50, 6], [53, 5, 53, 6, 52, 5, 52, 6], [57, 5, 57, 6, 58, 5, 58, 6], [59, 5, 59, 6, 60, 5, 60, 6], [61, 5, 61, 6, 62, 5, 62, 6], [67, 5, 67, 6, 66, 5, 66, 6], [69, 5, 69, 6, 68, 5, 68, 6], [73, 5, 73, 6, 74, 5, 74, 6], [75, 5, 75, 6, 76, 5, 76, 6], [77, 5, 77, 6, 78, 5, 78, 6], [83, 5, 83, 6, 82, 5, 82, 6], [85, 5, 85, 6, 84, 5, 84, 6], [89, 5, 89, 6, 90, 5, 90, 6], [91, 5, 91, 6, 92, 5, 92, 6], [93, 5, 93, 6, 94, 5, 94, 6], [1, 5, 1, 6, 0, 5, 0, 6, 0, 7, 0, 8], [15, 5, 15, 6, 15, 3, 15, 4, 14, 3, 14, 4], [17, 5, 17, 6, 16, 5, 16, 6, 16, 7, 16, 8], [31, 5, 31, 6, 31, 3, 31, 4, 30, 3, 30, 4], [33, 5, 33, 6, 32, 5, 32, 6, 32, 7, 32, 8], [47, 5, 47, 6, 47, 3, 47, 4, 46, 3, 46, 4], [49, 5, 49, 6, 48, 5, 48, 6, 48, 7, 48, 8], [63, 5, 63, 6, 63, 3, 63, 4, 62, 3, 62, 4], [65, 5, 65, 6, 64, 5, 64, 6, 64, 7, 64, 8], [79, 5, 79, 6, 79, 3, 79, 4, 78, 3, 78, 4], [81, 5, 81, 6, 80, 5, 80, 6, 80, 7, 80, 8], [95, 5, 95, 6, 95, 3, 95, 4, 94, 3, 94, 4], [8, 6, 8, 7, 23, 6, 23, 7], [10, 6, 10, 7, 21, 6, 21, 7], [12, 6, 12, 7, 19, 6, 19, 7], [14, 6, 14, 7, 17, 6, 17, 7], [16, 6, 16, 7, 31, 6, 31, 7], [18, 6, 18, 7, 29, 6, 29, 7], [20, 6, 20, 7, 27, 6, 27, 7], [22, 6, 22, 7, 25, 6, 25, 7], [24, 6, 24, 7, 39, 6, 39, 7], [26, 6, 26, 7, 37, 6, 37, 7], [28, 6, 28, 7, 35, 6, 35, 7], [30, 6, 30, 7, 33, 6, 33, 7], [32, 6, 32, 7, 47, 6, 47, 7], [34, 6, 34, 7, 45, 6, 45, 7], [36, 6, 36, 7, 43, 6, 43, 7], [38, 6, 38, 7, 41, 6, 41, 7], [40, 6, 40, 7, 55, 6, 55, 7], [42, 6, 42, 7, 53, 6, 53, 7], [44, 6, 44, 7, 51, 6, 51, 7], [46, 6, 46, 7, 49, 6, 49, 7], [48, 6, 48, 7, 63, 6, 63, 7], [50, 6, 50, 7, 61, 6, 61, 7], [52, 6, 52, 7, 59, 6, 59, 7], [54, 6, 54, 7, 57, 6, 57, 7], [56, 6, 56, 7, 71, 6, 71, 7], [58, 6, 58, 7, 69, 6, 69, 7], [60, 6, 60, 7, 67, 6, 67, 7], [62, 6, 62, 7, 65, 6, 65, 7], [64, 6, 64, 7, 79, 6, 79, 7], [66, 6, 66, 7, 77, 6, 77, 7], [68, 6, 68, 7, 75, 6, 75, 7], [70, 6, 70, 7, 73, 6, 73, 7], [72, 6, 72, 7, 87, 6, 87, 7], [74, 6, 74, 7, 85, 6, 85, 7], [76, 6, 76, 7, 83, 6, 83, 7], [78, 6, 78, 7, 81, 6, 81, 7], [88, 6, 88, 7, 88, 4, 88, 5, 87, 4, 87, 5], [90, 6, 90, 7, 90, 4, 90, 5, 85, 4, 85, 5], [92, 6, 92, 7, 92, 4, 92, 5, 83, 4, 83, 5], [94, 6, 94, 7, 94, 4, 94, 5, 81, 4, 81, 5], [1, 7, 1, 8, 2, 7, 2, 8], [3, 7, 3, 8, 4, 7, 4, 8], [5, 7, 5, 8, 6, 7, 6, 8], [11, 7, 11, 8, 10, 7, 10, 8], [13, 7, 13, 8, 12, 7, 12, 8], [17, 7, 17, 8, 18, 7, 18, 8], [19, 7, 19, 8, 20, 7, 20, 8], [21, 7, 21, 8, 22, 7, 22, 8], [27, 7, 27, 8, 26, 7, 26, 8], [29, 7, 29, 8, 28, 7, 28, 8], [33, 7, 33, 8, 34, 7, 34, 8], [35, 7, 35, 8, 36, 7, 36, 8], [37, 7, 37, 8, 38, 7, 38, 8], [43, 7, 43, 8, 42, 7, 42, 8], [45, 7, 45, 8, 44, 7, 44, 8], [49, 7, 49, 8, 50, 7, 50, 8], [51, 7, 51, 8, 52, 7, 52, 8], [53, 7, 53, 8, 54, 7, 54, 8], [59, 7, 59, 8, 58, 7, 58, 8], [61, 7, 61, 8, 60, 7, 60, 8], [65, 7, 65, 8, 66, 7, 66, 8], [67, 7, 67, 8, 68, 7, 68, 8], [69, 7, 69, 8, 70, 7, 70, 8], [75, 7, 75, 8, 74, 7, 74, 8], [77, 7, 77, 8, 76, 7, 76,

TABLE 28A-continued

8], [81, 7, 81, 8, 82, 7, 82, 8], [83, 7, 83, 8, 84, 7, 84, 8], [85, 7, 85, 8, 86, 7, 86, 8], [91, 7, 91, 8, 90, 7, 90, 8], [93, 7, 93, 8, 92, 7, 92, 8], [7, 7, 7, 8, 7, 5, 7, 6, 6, 5, 6, 6], [23, 7, 23, 8, 23, 5, 23, 6, 22, 5, 22, 6], [39, 7, 39, 8, 39, 5, 39, 6, 38, 5, 38, 6], [55, 7, 55, 8, 55, 5, 55, 6, 54, 5, 54, 6], [71, 7, 71, 8, 71, 5, 71, 6, 70, 5, 70, 6], [87, 7, 87, 8, 87, 5, 87, 6, 86, 5, 86, 6]

TABLE 28B

[86, 6, 86, 7, 89, 6, 89, 7, 89, 8, 0, 0], [84, 6, 84, 7, 91, 6, 91, 7, 91, 8, 0, 0], [82, 6, 82, 7, 93, 6, 93, 7, 93, 8, 0, 0], [80, 6, 80, 7, 95, 6, 95, 7, 95, 8, 0, 0], [9, 7, 9, 8, 8, 7, 8, 8], [15, 7, 15, 8, 14, 7, 14, 8], [25, 7, 25, 8, 24, 7, 24, 8], [31, 7, 31, 8, 30, 7, 30, 8], [41, 7, 41, 8, 40, 7, 40, 8], [47, 7, 47, 8, 46, 7, 46, 8], [57, 7, 57, 8, 56, 7, 56, 8], [63, 7, 63, 8, 62, 7, 62, 8], [73, 7, 73, 8, 72, 7, 72, 8], [79, 7, 79, 8, 78, 7, 78, 8], [89, 7, 89, 8, 88, 7, 88, 8], [95, 7, 95, 8, 94, 7, 94, 8], [8, 8, 0, 0, 7, 8, 0, 0], [10, 8, 0, 0, 5, 8, 0, 0], [12, 8, 0, 0, 3, 8, 0, 0], [14, 8, 0, 0, 1, 8, 0, 0], [16, 8, 0, 0, 15, 8, 0, 0], [18, 8, 0, 0, 13, 8, 0, 0], [20, 8, 0, 0, 11, 8, 0, 0], [22, 8, 0, 0, 9, 8, 0, 0], [24, 8, 0, 0, 23, 8, 0, 0], [26, 8, 0, 0, 21, 8, 0, 0], [28, 8, 0, 0, 19, 8, 0, 0], [30, 8, 0, 0, 17, 8, 0, 0], [32, 8, 0, 0, 31, 8, 0, 0], [34, 8, 0, 0, 29, 8, 0, 0], [36, 8, 0, 0, 27, 8, 0, 0], [38, 8, 0, 0, 25, 8, 0, 0], [40, 8, 0, 0, 39, 8, 0, 0], [42, 8, 0, 0, 37, 8, 0, 0], [44, 8, 0, 0, 35, 8, 0, 0], [46, 8, 0, 0, 33, 8, 0, 0], [48, 8, 0, 0, 47, 8, 0, 0],
[50, 8, 0, 0, 45, 8, 0, 0], [52, 8, 0, 0, 43, 8, 0, 0], [54, 8, 0, 0, 41, 8, 0, 0], [56, 8, 0, 0, 55, 8, 0, 0], [58, 8, 0, 0, 53, 8, 0, 0], [60, 8, 0, 0, 51, 8, 0, 0], [62, 8, 0, 0, 49, 8, 0, 0], [64, 8, 0, 0, 63, 8, 0, 0], [66, 8, 0, 0, 61, 8, 0, 0], [68, 8, 0, 0, 59, 8, 0, 0], [70, 8, 0, 0, 57, 8, 0, 0], [72, 8, 0, 0, 71, 8, 0, 0], [74, 8, 0, 0, 69, 8, 0, 0], [76, 8, 0, 0, 67, 8, 0, 0], [78, 8, 0, 0, 65, 8, 0, 0], [80, 8, 0, 0, 79, 8, 0, 0], [82, 8, 0, 0, 77, 8, 0, 0], [84, 8, 0, 0, 75, 8, 0, 0], [86, 8, 0, 0, 73, 8, 0, 0], [88, 8, 0, 0, 87, 8, 0, 0], [90, 8, 0, 0, 85, 8, 0, 0], [92, 8, 0, 0, 83, 8, 0, 0], [94, 8, 0, 0, 81, 8, 0, 0], [0, 8, 0, 0, 0, 6, 0, 7, 15, 6, 15, 7], [2, 8, 0, 0, 2, 6, 2, 7, 13, 6, 13, 7], [4, 8, 0, 0, 4, 6, 4, 7, 11, 6, 11, 7], [6, 8, 0, 0, 6, 6, 6, 7, 9, 6, 9, 7]

The core oligonucleotide sequences used to produce 8H×12H×128B nucleic acid structures of the invention are designated SEQ ID NOs. 4836-5481, and the corresponding voxel coordinates are shown respectively in Table 29A. The end oligonucleotide sequences used to produce 8H×12H×128B nucleic acid structures of the invention are designated SEQ ID NOs. 5610-5671, and the corresponding voxel coordinates are shown respectively in Table 29B. (See also Appendix, Table 11 of U.S. provisional application No. 61/675,309, filed Jul. 24, 2012, incorporated by reference herein.)

TABLE 29A

[0, 0, 0, 1, 0, 0, 0, 0], [0, 0, 2, 1, 0, 0, 0, 0], [0, 0, 4, 1, 0, 0, 0, 0], [0, 0, 6, 1, 0, 0, 0, 0], [0, 0, 89, 1, 0, 0, 0, 0], [0, 0, 91, 1, 0, 0, 0, 0], [0, 0, 93, 1, 0, 0, 0, 0], [0, 0, 95, 1, 0, 0, 0, 0], [0, 0, 16, 1, 0, 0, 15, 1], [0, 0, 18, 1, 0, 0, 13, 1], [0, 0, 20, 1, 0, 0, 11, 1], [0, 0, 22, 1, 0, 0, 9, 1], [0, 0, 24, 1, 0, 0, 23, 1], [0, 0, 26, 1, 0, 0, 21, 1], [0, 0, 28, 1, 0, 0, 19, 1], [0, 0, 30, 1, 0, 0, 17, 1], [0, 0, 32, 1, 0, 0, 31, 1], [0, 0, 34, 1, 0, 0, 29, 1], [0, 0, 36, 1, 0, 0, 27, 1], [0, 0, 38, 1, 0, 0, 25, 1], [0, 0, 40, 1, 0, 0, 39, 1], [0, 0, 42, 1, 0, 0, 37, 1], [0, 0, 44, 1, 0, 0, 35, 1], [0, 0, 46, 1, 0, 0, 33, 1], [0, 0, 48, 1, 0, 0, 47, 1], [0, 0, 50, 1, 0, 0, 45, 1], [0, 0, 52, 1, 0, 0, 43, 1], [0, 0, 54, 1, 0, 0, 41, 1], [0, 0, 56, 1, 0, 0, 55, 1], [0, 0, 58, 1, 0, 0, 53, 1], [0, 0, 60, 1, 0, 0, 51, 1], [0, 0, 62, 1, 0, 0, 49, 1], [0, 0, 64, 1, 0, 0, 63, 1], [0, 0, 66, 1, 0, 0, 61, 1], [0, 0, 68, 1, 0, 0, 59, 1], [0, 0, 70, 1, 0, 0, 57, 1], [0, 0, 72, 1, 0, 0, 71, 1], [0, 0, 74, 1, 0, 0, 69, 1], [0, 0, 76, 1, 0, 0, 67, 1], [0, 0, 78, 1, 0, 0, 65, 1], [0, 0, 80, 1, 0, 0, 79, 1], [0, 0, 82, 1, 0, 0, 77, 1], [0, 0, 84, 1, 0, 0, 75, 1], [0, 0, 86, 1, 0, 0, 73, 1], [0, 0, 14, 1, 0, 0, 1, 1, 1, 2, 1, 3], [0, 0, 12, 1, 0, 0, 3, 1, 3, 2, 3, 3], [0, 0, 10, 1, 0, 0, 5, 1, 5, 2, 5, 3], [0, 0, 8, 1, 0, 0, 7, 1, 7, 2, 7, 3], [8, 1, 8, 2, 0, 0, 0, 0], [15, 1, 15, 2, 0, 0, 0, 0], [24, 1, 24, 2, 0, 0, 0, 0], [31, 1, 31, 2, 0, 0, 0, 0], [40, 1, 40, 2, 0, 0, 0, 0], [47, 1, 47, 2, 0, 0, 0, 0], [56, 1, 56, 2, 0, 0, 0, 0], [63, 1, 63, 2, 0, 0, 0, 0], [72, 1, 72, 2, 0, 0, 0, 0], [79, 1, 79, 2, 0, 0, 0, 0], [88, 1, 88, 2, 0, 0, 0, 0], [95, 1, 95, 2, 0, 0, 0, 0], [3, 1, 3, 2, 2, 1, 2, 2], [5, 1, 5, 2, 4, 1, 4, 2], [9, 1, 9, 2, 10, 1, 10, 2], [11, 1, 11, 2, 12, 1, 12, 2], [13, 1, 13, 2, 14, 1, 14, 2], [19, 1, 19, 2, 18, 1, 18, 2], [21, 1, 21, 2, 20, 1, 20, 2], [25, 1, 25, 2, 26, 1, 26, 2], [27, 1, 27, 2, 28, 1, 28, 2], [29, 1, 29, 2, 30, 1, 30, 2], [35, 1, 35, 2, 34, 1, 34, 2], [37, 1, 37, 2, 36, 1, 36, 2], [41, 1, 41, 2, 42, 1, 42, 2], [43, 1, 43, 2, 44, 1, 44, 2], [45, 1, 45, 2, 46, 1, 46, 2], [51, 1, 51, 2, 50, 1, 50, 2], [53, 1, 53, 2, 52, 1, 52, 2], [57, 1, 57, 2, 58, 1, 58, 2], [59, 1, 59, 2, 60, 1, 60, 2], [61, 1, 61, 2, 62, 1, 62, 2], [67, 1, 67, 2, 66, 1, 66, 2], [69, 1, 69, 2, 68, 1, 68, 2], [73, 1, 73, 2, 74, 1, 74, 2], [75, 1, 75, 2, 76, 1, 76, 2], [77, 1, 77, 2, 78, 1, 78, 2], [83, 1, 83, 2, 82, 1, 82, 2], [85, 1, 85, 2, 84, 1, 84, 2], [89, 1, 89, 2, 90, 1, 90, 2], [91, 1, 91, 2, 92, 1, 92, 2], [93, 1, 93, 2, 94, 1, 94, 2], [1, 1, 1, 2, 0, 1, 0, 2, 0, 3, 0, 4], [17, 1, 17, 2, 16, 1, 16, 2, 16, 3, 16, 4], [33, 1, 33, 2, 32, 1, 32, 2, 32, 3, 32, 4], [49, 1, 49, 2, 48, 1, 48, 2, 48, 3, 48, 4], [65, 1, 65, 2, 64, 1, 64, 2, 64, 3, 64, 4], [81, 1, 81, 2, 80, 1, 80, 2, 80, 3, 80, 4], [8, 2, 8, 3, 23, 2, 23, 3], [10, 2, 10, 3, 21, 2, 21, 3], [12, 2, 12, 3, 19, 2, 19, 3], [14, 2, 14, 3, 17, 2, 17, 3], [16, 2, 16, 3, 31, 2, 31, 3], [18, 2, 18, 3, 29, 2, 29, 3], [20, 2, 20, 3, 27, 2, 27, 3], [22, 2, 22, 3, 25, 2, 25, 3], [24, 2, 24, 3, 39, 2, 39, 3], [26, 2, 26, 3, 37, 2, 37, 3], [28, 2, 28, 3, 35, 2, 35, 3], [30, 2, 30, 3, 33, 2, 33, 3], [32, 2, 32, 3, 47, 2, 47, 3], [34, 2, 34, 3, 45, 2, 45, 3], [36, 2, 36, 3, 43, 2, 43, 3], [38, 2, 38, 3, 41, 2, 41, 3], [40, 2, 40, 3, 55, 2, 55, 3], [42, 2, 42, 3, 53, 2, 53, 3], [44, 2, 44, 3, 51, 2, 51, 3], [46, 2, 46, 3, 49, 2, 49, 3], [48, 2, 48, 3, 63, 2, 63, 3], [50, 2, 50, 3, 61, 2, 61, 3], [52, 2, 52, 3, 59, 2, 59, 3], [54, 2, 54, 3, 57, 2, 57, 3], [56, 2, 56, 3, 71, 2, 71, 3], [58, 2, 58, 3, 69, 2, 69, 3], [60, 2, 60, 3, 67, 2, 67, 3], [62, 2, 62, 3, 65, 2, 65, 3], [64, 2, 64, 3, 79, 2, 79, 3], [66, 2, 66, 3, 77, 2, 77, 3], [68, 2, 68, 3, 75, 2, 75, 3], [70, 2, 70, 3, 73, 2, 73, 3], [72, 2, 72, 3, 87, 2, 87, 3], [74, 2, 74, 3, 85, 2, 85, 3], [76, 2, 76, 3, 83, 2, 83, 3], [78, 2, 78, 3, 81, 2, 81, 3], [88, 2, 88, 3, 0, 0, 88, 1, 0, 0, 87, 1], [90, 2, 90, 3, 0, 0, 90, 1, 0, 0, 85, 1], [92, 2, 92, 3, 0, 0, 92, 1, 0, 0, 83, 1], [94, 2, 94, 3, 0, 0, 94, 1, 0, 0, 81, 1], [1, 3, 1, 4, 2, 3, 2, 4], [3, 3, 3, 4, 4, 3, 4, 4], [5, 3, 5, 4, 6, 3, 6, 4], [11, 3, 11, 4, 10, 3, 10, 4], [13, 3, 13, 4, 12, 3, 12, 4], [17, 3, 17, 4, 18, 3, 18, 4], [19, 3, 19, 4, 20, 3, 20, 4], [21, 3, 21, 4, 22, 3, 22, 4], [27, 3, 27, 4, 26, 3, 26, 4], [29, 3, 29, 4, 28, 3, 28, 4], [33, 3, 33, 4, 34, 3, 34, 4], [35, 3, 35, 4, 36, 3, 36, 4], [37, 3, 37, 4, 38, 3, 38, 4], [43, 3, 43, 4, 42, 3, 42, 4], [45, 3, 45, 4, 44, 3, 44, 4], [49, 3, 49, 4, 50, 3, 50, 4], [51, 3, 51, 4, 52, 3, 52, 4], [53, 3, 53, 4, 54, 3, 54, 4], [59, 3, 59, 4, 58, 3, 58, 4], [61, 3, 61, 4, 60, 3, 60, 4], [65, 3, 65, 4, 66, 3, 66, 4], [67, 3, 67, 4, 68, 3, 68, 4], [69, 3, 69, 4, 70, 3, 70, 4], [75, 3, 75, 4, 74, 3, 74, 4], [77, 3, 77, 4, 76, 3, 76, 4], [81, 3, 81, 4, 82, 3, 82, 4], [83, 3, 83, 4, 84, 3, 84, 4], [85, 3, 85, 4, 86, 3, 86, 4], [91, 3, 91, 4, 90, 3, 90, 4], [93, 3, 93, 4, 92, 3, 92, 4], [7, 3, 7, 4, 7, 1, 7, 2, 6, 1, 6, 2], [23, 3, 23, 4, 23, 1, 23, 2, 22, 1, 22, 2], [39, 3, 39, 4, 39, 1, 39, 2, 38, 1, 38, 2], [55, 3, 55, 4, 55, 1, 55, 2, 54, 1, 54, 2], [71, 3, 71, 4, 71, 1, 71, 2, 70, 1, 70, 2], [87, 3, 87, 4, 87, 1, 87, 2, 86, 1, 86, 2], [86, 2, 86, 3, 89, 2, 89, 3, 89, 4, 89, 5], [84, 2, 84, 3, 91, 2, 91, 3, 91, 4, 91, 5], [82, 2, 82, 3, 93, 2, 93, 3, 93, 4, 93, 5], [80, 2, 80, 3, 95, 2, 95, 3, 95, 4, 95, 5], [9, 3, 9, 4, 8, 3, 8, 4, 8, 5, 8, 6], [25, 3, 25, 4, 24, 3, 24, 4, 24, 5, 24, 6], [41, 3, 41, 4, 40, 3, 40, 4, 40, 5, 40, 6], [57, 3, 57, 4, 56, 3, 56, 4, 56, 5, 56, 6], [73, 3, 73, 4, 72, 3, 72, 4, 72, 5, 72, 6], [89, 3, 89, 4, 88, 3, 88, 4, 88, 5, 88, 6], [16, 4, 16, 5, 15, 4, 15, 5], [18, 4, 18, 5, 13, 4, 13, 5], [20, 4, 20, 5, 11, 4, 11, 5], [22, 4, 22, 5, 9, 4, 9, 5], [24, 4, 24, 5, 23, 4, 23, 5], [26, 4, 26, 5, 21, 4, 21, 5], [28, 4, 28, 5, 19, 4, 19, 5], [30, 4, 30, 5, 17, 4, 17, 5], [32, 4, 32, 5, 31, 4, 31, 5], [34, 4, 34, 5, 29, 4, 29, 5], [36, 4, 36, 5, 27, 4, 27, 5], [38, 4, 38, 5, 25, 4, 25, 5], [40, 4, 40, 5, 39, 4, 39, 5], [42, 4, 42, 5, 37, 4, 37, 5], [44, 4, 44, 5, 35, 4, 35, 5], [46, 4, 46, 5, 33, 4, 33, 5], [48, 4, 48, 5, 47, 4, 47, 5], [50, 4, 50, 5, 45, 4, 45, 5], [52, 4, 52, 5, 43, 4, 43, 5], [54, 4, 54, 5, 41, 4, 41, 5], [56, 4, 56, 5, 55, 4, 55, 5], [58, 4, 58, 5, 53, 4, 53, 5], [60, 4, 60, 5, 51, 4, 51, 5], [62, 4, 62, 5, 49, 4, 49, 5], [64, 4, 64, 5, 63, 4, 63, 5], [66, 4, 66, 5, 61, 4, 61, 5], [68, 4, 68, 5, 59, 4, 59, 5], [70, 4, 70, 5, 57, 4, 57, 5], [72, 4, 72, 5, 71, 4, 71, 5], [74, 4, 74, 5, 69, 4, 69, 5], [76, 4, 76, 5, 67, 4, 67, 5], [78, 4, 78, 5, 65, 4, 65, 5], [80, 4, 80, 5, 79, 4, 79, 5], [82, 4, 82, 5, 77, 4,

TABLE 29A-continued 77, 5], [84, 4, 84, 5, 75, 4, 75, 5], [86, 4, 86, 5, 73, 4, 73, 5], [0, 4, 0, 5, 0, 2, 0, 3, 15, 2, 15, 3], [14, 4, 14, 5, 1, 4, 1, 5, 1, 6, 1, 7], [2, 4, 2, 5, 2, 2, 2, 3, 13, 2, 13, 3], [12, 4, 12, 5, 3, 4, 3, 5, 3, 6, 3, 7], [4, 4, 4, 5, 4, 2, 4, 3, 11, 2, 11, 3], [10, 4, 10, 5, 5, 4, 5, 5, 5, 6, 5, 7], [6, 4, 6, 5, 6, 2, 6, 3, 9, 2, 9, 3], [8, 4, 8, 5, 7, 4, 7, 5, 7, 6, 7, 7], [3, 5, 3, 6, 2, 5, 2, 6], [5, 5, 5, 6, 4, 5, 4, 6], [9, 5, 9, 6, 10, 5, 10, 6], [11, 5, 11, 6, 12, 5, 12, 6], [13, 5, 13, 6, 14, 5, 14, 6], [19, 5, 19, 6, 18, 5, 18, 6], [21, 5, 21, 6, 20, 5, 20, 6], [25, 5, 25, 6, 26, 5, 26, 6], [27, 5, 27, 6, 28, 5, 28, 6], [29, 5, 29, 6, 30, 5, 30, 6], [35, 5, 35, 6, 34, 5, 34, 6], [37, 5, 37, 6, 36, 5, 36, 6], [41, 5, 41, 6, 42, 5, 42, 6], [43, 5, 43, 6, 44, 5, 44, 6], [45, 5, 45, 6, 46, 5, 46, 6], [51, 5, 51, 6, 50, 5, 50, 6], [53, 5, 53, 6, 52, 5, 52, 6], [57, 5, 57, 6, 58, 5, 58, 6], [59, 5, 59, 6, 60, 5, 60, 6], [61, 5, 61, 6, 62, 5, 62, 6], [67, 5, 67, 6, 66, 5, 66, 6], [69, 5, 69, 6, 68, 5, 68, 6], [73, 5, 73, 6, 74, 5, 74, 6], [75, 5, 75, 6, 76, 5, 76, 6], [77, 5, 77, 6, 78, 5, 78, 6], [83, 5, 83, 6, 82, 5, 82, 6], [85, 5, 85, 6, 84, 5, 84, 6], [89, 5, 89, 6, 90, 5, 90, 6], [91, 5, 91, 6, 92, 5, 92, 6], [93, 5, 93, 6, 94, 5, 94, 6], [1, 5, 1, 6, 0, 5, 0, 6, 0, 7, 0, 8], [15, 5, 15, 6, 15, 3, 15, 4, 14, 3, 14, 4], [17, 5, 17, 6, 16, 5, 16, 6, 16, 7, 16, 8], [31, 5, 31, 6, 31, 3, 31, 4, 30, 3, 30, 4], [33, 5, 33, 6, 32, 5, 32, 6, 32, 7, 32, 8], [47, 5, 47, 6, 47, 3, 47, 4, 46, 3, 46, 4], [49, 5, 49, 6, 48, 5, 48, 6, 48, 7, 48, 8], [63, 5, 63, 6, 63, 3, 63, 4, 62, 3, 62, 4], [65, 5, 65, 6, 64, 5, 64, 6, 64, 7, 64, 8], [79, 5, 79, 6, 79, 3, 79, 4, 78, 3, 78, 4], [81, 5, 81, 6, 80, 5, 80, 6, 80, 7, 80, 8], [95, 5, 95, 6, 95, 3, 95, 4, 94, 3, 94, 4], [8, 6, 8, 7, 23, 6, 23, 7], [10, 6, 10, 7, 21, 6, 21, 7], [12, 6, 12, 7, 19, 6, 19, 7], [14, 6, 14, 7, 17, 6, 17, 7], [16, 6, 16, 7, 31, 6, 31, 7], [18, 6, 18, 7, 29, 6, 29, 7], [20, 6, 20, 7, 27, 6, 27, 7], [22, 6, 22, 7, 25, 6, 25, 7], [24, 6, 24, 7, 39, 6, 39, 7], [26, 6, 26, 7, 37, 6, 37, 7], [28, 6, 28, 7, 35, 6, 35, 7], [30, 6, 30, 7, 33, 6, 33, 7], [32, 6, 32, 7, 47, 6, 47, 7], [34, 6, 34, 7, 45, 6, 45, 7], [36, 6, 36, 7, 43, 6, 43, 7], [38, 6, 38, 7, 41, 6, 41, 7], [40, 6, 40, 7, 55, 6, 55, 7], [42, 6, 42, 7, 53, 6, 53, 7], [44, 6, 44, 7, 51, 6, 51, 7], [46, 6, 46, 7, 49, 6, 49, 7], [48, 6, 48, 7, 63, 6, 63, 7], [50, 6, 50, 7, 61, 6, 61, 7], [52, 6, 52, 7, 59, 6, 59, 7], [54, 6, 54, 7, 57, 6, 57, 7], [56, 6, 56, 7, 71, 6, 71, 7], [58, 6, 58, 7, 69, 6, 69, 7], [60, 6, 60, 7, 67, 6, 67, 7], [62, 6, 62, 7, 65, 6, 65, 7], [64, 6, 64, 7, 79, 6, 79, 7], [66, 6, 66, 7, 77, 6, 77, 7], [68, 6, 68, 7, 75, 6, 75, 7], [70, 6, 70, 7, 73, 6, 73, 7], [72, 6, 72, 7, 87, 6, 87, 7], [74, 6, 74, 7, 85, 6, 85, 7], [76, 6, 76, 7, 83, 6, 83, 7], [78, 6, 78, 7, 81, 6, 81, 7], [88, 6, 88, 7, 88, 4, 88, 5, 87, 4, 87, 5], [90, 6, 90, 7, 90, 4, 90, 5, 85, 4, 85, 5], [92, 6, 92, 7, 92, 4, 92, 5, 83, 4, 83, 5], [94, 6, 94, 7, 94, 4, 94, 5, 81, 4, 81, 5], [1, 7, 1, 8, 2, 7, 2, 8], [3, 7, 3, 8, 4, 7, 4, 8], [5, 7, 5, 8, 6, 7, 6, 8], [11, 7, 11, 8, 10, 7, 10, 8], [13, 7, 13, 8, 12, 7, 12, 8], [17, 7, 17, 8, 18, 7, 18, 8], [19, 7, 19, 8, 20, 7, 20, 8], [21, 7, 21, 8, 22, 7, 22, 8], [27, 7, 27, 8, 26, 7, 26, 8], [29, 7, 29, 8, 28, 7, 28, 8], [33, 7, 33, 8, 34, 7, 34, 8], [35, 7, 35, 8, 36, 7, 36, 8], [37, 7, 37, 8, 38, 7, 38, 8], [43, 7, 43, 8, 42, 7, 42, 8], [45, 7, 45, 8, 44, 7, 44, 8], [49, 7, 49, 8, 50, 7, 50, 8], [51, 7, 51, 8, 52, 7, 52, 8], [53, 7, 53, 8, 54, 7, 54, 8], [59, 7, 59, 8, 58, 7, 58, 8], [61, 7, 61, 8, 60, 7, 60, 8], [65, 7, 65, 8, 66, 7, 66, 8], [67, 7, 67, 8, 68, 7, 68, 8], [69, 7, 69, 8, 70, 7, 70, 8], [75, 7, 75, 8, 74, 7, 74, 8], [77, 7, 77, 8, 76, 7, 76, 8], [81, 7, 81, 8, 82, 7, 82, 8], [83, 7, 83, 8, 84, 7, 84, 8], [85, 7, 85, 8, 86, 7, 86, 8], [91, 7, 91, 8, 90, 7, 90, 8], [93, 7, 93, 8, 92, 7, 92, 8], [7, 7, 7, 8, 7, 5, 7, 6, 6, 5, 6, 6], [23, 7, 23, 8, 23, 5, 23, 6, 22, 5, 22, 6], [39, 7, 39, 8, 39, 5, 39, 6, 38, 5, 38, 6], [55, 7, 55, 8, 55, 5, 55, 6, 54, 5, 54, 6], [71, 7, 71, 8, 71, 5, 71, 6, 70, 5, 70, 6], [87, 7, 87, 8, 87, 5, 87, 6, 86, 5, 86, 6], [86, 6, 86, 7, 89, 6, 89, 7, 89, 8, 89, 9], [84, 6, 84, 7, 91, 6, 91, 7, 91, 8, 91, 9], [82, 6, 82, 7, 93, 6, 93, 7, 93, 8, 93, 9], [80, 6, 80, 7, 95, 6, 95, 7, 95, 8, 95, 9], [9, 7, 9, 8, 8, 7, 8, 8, 8, 9, 8, 10], [25, 7, 25, 8, 24, 7, 24, 8, 24, 9, 24, 10], [41, 7, 41, 8, 40, 7, 40, 8, 40, 9, 40, 10], [57, 7, 57, 8, 56, 7, 56, 8, 56, 9, 56, 10], [73, 7, 73, 8, 72, 7, 72, 8, 72, 9, 72, 10], [89, 7, 89, 8, 88, 7, 88, 8, 88, 9, 88, 10], [16, 8, 16, 9, 15, 8, 15, 9], [18, 8, 18, 9, 13, 8, 13, 9], [20, 8, 20, 9, 11, 8, 11, 9], [22, 8, 22, 9, 9, 8, 9, 9], [24, 8, 24, 9, 23, 8, 23, 9], [26, 8, 26, 9, 21, 8, 21, 9], [28, 8, 28, 9, 19, 8, 19, 9], [30, 8, 30, 9, 17, 8, 17, 9], [32, 8, 32, 9, 31, 8, 31, 9], [34, 8, 34, 9, 29, 8, 29, 9], [36, 8, 36, 9, 27, 8, 27, 9], [38, 8, 38, 9, 25, 8, 25, 9], [40, 8, 40, 9, 39, 8, 39, 9], [42, 8, 42, 9, 37, 8, 37, 9], [44, 8, 44, 9, 35, 8, 35, 9], [46, 8, 46, 9, 33, 8, 33, 9], [48, 8, 48, 9, 47, 8, 47, 9], [50, 8, 50, 9, 45, 8, 45, 9], [52, 8, 52, 9, 43, 8, 43, 9], [54, 8, 54, 9, 41, 8, 41, 9], [56, 8, 56, 9, 55, 8, 55, 9], [58, 8, 58, 9, 53, 8, 53, 9], [60, 8, 60, 9, 51, 8, 51, 9], [62, 8, 62, 9, 49, 8, 49, 9], [64, 8, 64, 9, 63, 8, 63, 9], [66, 8, 66, 9, 61, 8, 61, 9], [68, 8, 68, 9, 59, 8, 59, 9], [70, 8, 70, 9, 57, 8, 57, 9], [72, 8, 72, 9, 71, 8, 71, 9], [74, 8, 74, 9, 69, 8, 69, 9], [76, 8, 76, 9, 67, 8, 67, 9], [78, 8, 78, 9, 65, 8, 65, 9], [80, 8, 80, 9, 79, 8, 79, 9], [82, 8, 82, 9, 77, 8, 77, 9], [86, 8, 86, 9, 73, 8, 73, 9], [0, 8, 0, 9, 0, 6, 0, 7, 15, 6, 15, 7], [14, 8, 14, 9, 1, 8, 1, 9, 1, 10, 1, 11], [2, 8, 2, 9, 2, 6, 2, 7, 13, 6, 13, 7], [12, 8, 12, 9, 3, 8, 3, 9, 3, 10, 3, 11], [4, 8, 4, 9, 4, 6, 4, 7, 11, 6, 11, 7], [10, 8, 10, 9, 5, 8, 5, 9, 5, 10, 5, 11], [6, 8, 6, 9, 6, 6, 6, 7, 9, 6, 9, 7], [8, 8, 8, 9, 7, 8, 7, 9, 7, 10, 7, 11], [3, 9, 3, 10, 2, 9, 2, 10], [5, 9, 5, 10, 4, 9, 4, 10], [9, 9, 9, 10, 10, 9, 10, 10], [11, 9, 11, 10, 12, 9, 12, 10], [13, 9, 13, 10, 14, 9, 14, 10], [19, 9, 19, 10, 18, 9, 18, 10], [21, 9, 21, 10, 20, 9, 20, 10], [25, 9, 25, 10, 26, 9, 26, 10], [27, 9, 27, 10, 28, 9, 28, 10], [29, 9, 29, 10, 30, 9, 30, 10], [35, 9, 35, 10, 34, 9, 34, 10], [37, 9, 37, 10, 36, 9, 36, 10], [41, 9, 41, 10, 42, 9, 42, 10], [43, 9, 43, 10, 44, 9, 44, 10], [45, 9, 45, 10, 46, 9, 46, 10], [51, 9, 51, 10, 50, 9, 50, 10], [53, 9, 53, 10, 52, 9, 52, 10], [57, 9, 57, 10, 58, 9, 58, 10], [59, 9, 59, 10, 60, 9, 60, 10], [61, 9, 61, 10, 62, 9, 62, 10], [67, 9, 67, 10, 66, 9, 66, 10], [69, 9, 69, 10, 68, 9, 68, 10], [73, 9, 73, 10, 74, 9, 74, 10], [75, 9, 75, 10, 76, 9, 76, 10], [77, 9, 77, 10, 78, 9, 78, 10], [83, 9, 83, 10, 82, 9, 82, 10], [85, 9, 85, 10, 84, 9, 84, 10], [89, 9, 89, 10, 90, 9, 90, 10], [91, 9, 91, 10, 92, 9, 92, 10], [93, 9, 93, 10, 94, 9, 94, 10], [1, 9, 1, 10, 0, 9, 0, 10, 0, 11, 0, 12], [15, 9, 15, 10, 15, 7, 15, 8, 14, 7, 14, 8], [17, 9, 17, 10, 16, 9, 16, 10, 16, 11, 16, 12], [31, 9, 31, 10, 31, 7, 31, 8, 30, 7, 30, 8], [33, 9, 33, 10, 32, 9, 32, 10, 32, 11, 32, 12], [47, 9, 47, 10, 47, 7, 47, 8, 46, 7, 46, 8], [49, 9, 49, 10, 48, 9, 48, 10, 48, 11, 48, 12], [63, 9, 63, 10, 63, 7, 63, 8, 62, 7, 62, 8], [65, 9, 65, 10, 64, 9, 64, 10, 64, 11, 64, 12], [79, 9, 79, 10, 79, 7, 79, 8, 78, 7, 78, 8], [81, 9, 81, 10, 80, 9, 80, 10, 80, 11, 80, 12], [95, 9, 95, 10, 95, 7, 95, 8, 94, 7, 94, 8], [8, 10, 8, 11, 23, 10, 23, 11], [10, 10, 10, 11, 21, 10, 21, 11], [12, 10, 12, 11, 19, 10, 19, 11], [14, 10, 14, 11, 17, 10, 17, 11], [16, 10, 16, 11, 31, 10, 31, 11], [18, 10, 18, 11, 29, 10, 29, 11], [20, 10, 20, 11, 27, 10, 27, 11], [22, 10, 22, 11, 25, 10, 25, 11], [24, 10, 24, 11, 39, 10, 39, 11], [26, 10, 26, 11, 37, 10, 37, 11], [28, 10, 28, 11, 35, 10, 35, 11], [30, 10, 30, 11, 33, 10, 33, 11], [32, 10, 32, 11, 47, 10, 47, 11], [34, 10, 34, 11, 45, 10, 45, 11], [36, 10, 36, 11, 43, 10, 43, 11], [38, 10, 38, 11, 41, 10, 41, 11], [40, 10, 40, 11, 55, 10, 55, 11], [42, 10, 42, 11, 53, 10, 53, 11], [44, 10, 44, 11, 51, 10, 51, 11], [46, 10, 46, 11, 49, 10, 49, 11], [48, 10, 48, 11, 63, 10, 63, 11], [50, 10, 50, 11, 61, 10, 61, 11], [52, 10, 52, 11, 59, 10, 59, 11], [54, 10, 54, 11, 57, 10, 57, 11], [56, 10, 56, 11, 71, 10, 71, 11], [58, 10, 58, 11, 69, 10, 69, 11], [60, 10, 60, 11, 67, 10, 67, 11], [62, 10, 62, 11, 65, 10, 65, 11], [64, 10, 64, 11, 79, 10, 79, 11], [66, 10, 66, 11, 77, 10, 77, 11], [68, 10, 68, 11, 75, 10, 75, 11], [70, 10, 70, 11, 73, 10, 73, 11], [72, 10, 72, 11, 87, 10, 87, 11], [74, 10, 74, 11, 85, 10, 85, 11], [76, 10, 76, 11, 83, 10, 83, 11], [78, 10, 78, 11, 81, 10, 81, 11], [88, 10, 88, 11, 88, 9, 88, 7, 87, 9], [86, 10, 86, 11, 89, 10, 89, 11, 89, 12, 89, 13], [90, 10, 90, 11, 90, 8, 90, 9, 85, 8, 85, 9], [84, 10, 84, 11, 91, 10, 91, 11, 91, 12, 91, 13], [92, 10, 92, 11, 92, 8, 92, 9, 83, 8, 83, 9], [82, 10, 82, 11, 93, 10, 93, 11, 93, 12, 93, 13], [94, 10, 94, 11, 94, 8, 94, 9, 81, 8, 81, 9], [80, 10, 80, 11, 95, 10, 95, 11, 95, 12, 95, 13], [1, 11, 1, 2, 2, 11, 2, 12], [3, 11, 3, 12, 4, 11, 4, 12], [5, 11, 5, 12, 6, 11, 6, 12], [11, 11, 11, 12, 10, 11, 10, 12], [13, 11, 13, 12, 12, 11, 12, 12], [17, 11, 17, 12, 18, 11, 18, 12], [19, 11, 19, 12, 20, 11, 20, 12], [21, 11, 21, 12, 22, 11, 22, 12], [27, 11, 27, 12, 26, 11, 26, 12], [29, 11, 29, 12, 28, 11, 28, 12], [33, 11, 33, 12, 34, 11, 34, 12], [35, 11, 35, 12, 36, 11, 36, 12], [37, 11, 37, 12, 38, 11, 38, 12], [43, 11, 43, 12, 42, 11, 42, 12], [45, 11, 45, 12, 44, 11, 44, 12], [49, 11, 49, 12, 50, 11, 50, 12], [51, 11, 51, 12, 52, 11, 52, 12], [53, 11, 53, 12, 54, 11, 54, 12], [59, 11, 59, 12, 58, 11, 58, 12], [61, 11, 61, 12, 60, 11, 60, 12], [65, 11, 65, 12, 66, 11, 66, 12], [67, 11, 67, 12, 68, 11, 68, 12], [69, 11, 69, 12, 70, 11, 70, 12], [75, 11, 75, 12, 74, 11, 74, 12], [77, 11, 77, 12, 76, 11, 76, 12], [81, 11, 81, 12, 82, 11, 82, 12], [83, 11, 83, 12, 84, 11, 84, 12], [85, 11, 85, 12, 86, 11, 86, 12], [91, 11, 91, 12, 90, 11, 90, 12], [93, 11, 93, 12, 92, 11, 92, 12], [7, 11, 7, 12, 7, 9, 7, 10, 6, 9, 6, 10], [9, 11, 9, 12, 8, 11, 8, 12, 8, 13, 8, 14], [23, 11, 23, 12, 23, 9, 23, 10, 22, 9, 22, 10], [25, 11, 25, 12, 24, 11, 24, 12, 24, 13, 24, 14], [39, 11, 39, 12, 39, 9, 39, 10, 38, 9, 38, 10], [41, 11, 41, 12, 40, 11, 40, 12, 40, 13, 40, 14], [55, 11, 55, 12, 55, 9, 55, 10, 54, 9, 54, 10], [57, 11, 57, 12, 56, 12, 56, 13, 56, 14], [71, 11, 71, 12, 71, 9, 71, 10, 70, 9, 70, 10], [73, 11, 73, 12, 72, 11, 72, 12, 72, 13, 72, 14], [87, 11, 87, 12, 87, 9, 87, 10, 86, 9, 86, 10], [89, 11, 89, 12, 88, 11, 88, 12, 88, 13, 88, 14], [16, 12, 16, 13, 15, 12, 15, 13], [18, 12, 18, 13, 13, 12, 13, 13], [20, 12, 20, 13, 11, 12, 11, 13], [22, 12, 22, 13, 9, 12, 9, 13], [24, 12, 24, 13, 23, 12, 23, 13], [26, 12, 26, 13, 21, 12, 21, 13], [28, 12, 28, 13, 19, 12, 19, 13], [30, 12, 30, 13, 17, 12, 17, 13], [32, 12, 32, 13, 31, 12, 31, 13], [34, 12, 34, 13, 29, 12, 29, 13], [36, 12, 36, 13, 27, 12, 27, 13], [38, 12, 38, 13, 25, 12, 25, 13], [40, 12, 40, 13, 39, 12, 39, 13], [42, 12, 42, 13, 37, 12, 37, 13], [44, 12, 44, 13, 35, 12, 35, 13], [46, 12, 46, 13, 33, 12, 33, 13], [48, 12, 48, 13, 47, 12, 47, 13], [50, 12, 50, 13, 45, 12, 45, 13], [52, 12, 52, 13, 43, 12, 43, 13], [54, 12, 54, 13, 41, 12, 41, 13], [56, 12, 56, 13, 55, 12, 55, 13], [58, 12, 58, 13, 53, 12, 53, 13], [60, 12, 60, 13, 51, 12, 51, 13], [62, 12, 62, 13, 49, 12, 49, 13], [64, 12, 64, 13, 63, 12, 63, 13], [66, 12, 66, 13, 61, 12, 61, 13], [68, 12, 68, 13, 59, 12, 59, 13], [70, 12, 70, 13, 57, 12, 57, 13], [72, 12, 72, 13, 71, 12, 71, 13], [74, 12, 74, 13, 69, 12, 69, 13], [76, 12, 76, 13, 67, 12, 67, 13], [78, 12, 78, 13, 65, 12, 65, 13], [80, 12, 80, 13, 79, 12, 79, 13], [82, 12, 82, 13,

TABLE 29A-continued 77, 12, 77, 13], [84, 12, 84, 13, 75, 12, 75, 13], [86, 12, 86, 13, 73, 12, 73, 13], [0, 12, 0, 13, 0, 10, 0, 11, 15, 10, 15, 11], [14, 12, 14, 13, 1, 12, 1, 13, 1, 14, 1, 15], [2, 12, 2, 13, 2, 10, 2, 11, 13, 10, 13, 11], [12, 12, 12, 13, 3, 12, 3, 13, 3, 14, 3, 15], [4, 12, 4, 13, 4, 10, 4, 11, 11, 10, 11, 11], [10, 12, 10, 13, 5, 12, 5, 13, 5, 14, 5, 15], [6, 12, 6, 13, 6, 10, 6, 11, 9, 10, 9, 11], [8, 12, 8, 13, 7, 12, 7, 13, 7, 14, 7, 15], [3, 13, 3, 14, 2, 13, 2, 14], [5, 13, 5, 14, 4, 13, 4, 14], [9, 13, 9, 14, 10, 13, 10, 14], [11, 13, 11, 14, 12, 13, 12, 14], [13, 13, 13, 14, 14, 13, 14, 14], [19, 13, 19, 14, 18, 13, 18, 14], [21, 13, 21, 14, 20, 13, 20, 14], [25, 13, 25, 14, 26, 13, 26, 14], [27, 13, 27, 14, 28, 13, 28, 14], [29, 13, 29, 14, 30, 13, 30, 14], [35, 13, 35, 14, 34, 13, 34, 14], [37, 13, 37, 14, 36, 13, 36, 14], [41, 13, 41, 14, 42, 13, 42, 14], [43, 13, 43, 14, 44, 13, 44, 14], [45, 13, 45, 14, 46, 13, 46, 14], [51, 13, 51, 14, 50, 13, 50, 14], [53, 13, 53, 14, 52, 13, 52, 14], [57, 13, 57, 14, 58, 13, 58, 14], [59, 13, 59, 14, 60, 13, 60, 14], [61, 13, 61, 14, 62, 13, 62, 14], [67, 13, 67, 14, 66, 13, 66, 14], [69, 13, 69, 14, 68, 13, 68, 14], [73, 13, 73, 14, 74, 13, 74, 14], [75, 13, 75, 14, 76, 13, 76, 14], [77, 13, 77, 14, 78, 13, 78, 14], [83, 13, 83, 14, 82, 13, 82, 14], [85, 13, 85, 14, 84, 13, 84, 14], [89, 13, 89, 14, 90, 13, 90, 14], [91, 13, 91, 14, 92, 13, 92, 14], [93, 13, 93, 14, 94, 13, 94, 14], [15, 13, 15, 14, 15, 11, 15, 12, 14, 11, 14, 12], [31, 13, 31, 14, 31, 11, 31, 12, 30, 11, 30, 12], [47, 13, 47, 14, 47, 11, 47, 12, 46, 11, 46, 12], [63, 13, 63, 14, 63, 11, 63, 12, 62, 11, 62, 12], [79, 13, 79, 14, 79, 11, 79, 12, 78, 11, 78, 12], [95, 13, 95, 14, 95, 11, 95, 12, 94, 11, 94, 12], [8, 14, 8, 15, 23, 14, 23, 15], [10, 14, 10, 15, 21, 14, 21, 15], [12, 14, 12, 15, 19, 14, 19, 15], [14, 14, 14, 15, 17, 14, 17, 15], [16, 14, 16, 15, 31, 14, 31, 15], [18, 14, 18, 15, 29, 14, 29, 15], [20, 14, 20, 15, 27, 14, 27, 15], [22, 14, 22, 15, 25, 14, 25, 15], [24, 14, 24, 15, 39, 14, 39, 15], [26, 14, 26, 15, 37, 14, 37, 15], [28, 14, 28, 15, 35, 14, 35, 15], [30, 14, 30, 15, 33, 14, 33, 15], [32, 14, 32, 15, 47, 14, 47, 15], [34, 14, 34, 15, 45, 14, 45, 15], [36, 14, 36, 15, 43, 14, 43, 15], [38, 14, 38, 15, 41, 14, 41, 15], [40, 14, 40, 15, 55, 14, 55, 15], [42, 14, 42, 15, 53, 14, 53, 15], [44, 14, 44, 15, 51, 14, 51, 15], [46, 14, 46, 15, 49, 14, 49, 15], [48, 14, 48, 15, 63, 14, 63, 15], [50, 14, 50, 15, 61, 14, 61, 15], [52, 14, 52, 15, 59, 14, 59, 15], [54, 14, 54, 15, 57, 14, 57, 15], [56, 14, 56, 15, 71, 14, 71, 15], [58, 14, 58, 15, 69, 14, 69, 15], [60, 14, 60, 15, 67, 14, 67, 15], [62, 14, 62, 15, 65, 14, 65, 15], [64, 14, 64, 15, 79, 14, 79, 15], [66, 14, 66, 15, 77, 14, 77, 15], [68, 14, 68, 15, 75, 14, 75, 15], [70, 14, 70, 15, 73, 14, 73, 15], [72, 14, 72, 15, 87, 14, 87, 15], [74, 14, 74, 15, 85, 14, 85, 15], [76, 14, 76, 15, 83, 14, 83, 15], [78, 14, 78, 15, 81, 14, 81, 15], [88, 14, 88, 15, 88, 12, 88, 13, 87, 12, 87, 13], [90, 14, 90, 15, 90, 12, 90, 13, 85, 12, 85, 13], [92, 14, 92, 15, 92, 12, 92, 13, 83, 12, 83, 13], [94, 14, 94, 15, 94, 12, 94, 13, 81, 12, 81, 13]

TABLE 29B

[1, 13, 1, 14, 0, 13, 0, 14, 0, 15, 0, 0], [17, 13, 17, 14, 16, 13, 16, 14, 16, 15, 0, 0], [33, 13, 33, 14, 32, 13, 32, 14, 32, 15, 0, 0], [49, 13, 49, 14, 48, 13, 48, 14, 48, 15, 0, 0], [65, 13, 65, 14, 64, 13, 64, 14, 64, 15, 0, 0], [81, 13, 81, 14, 80, 13, 80, 14, 80, 15, 0, 0], [0, 14, 0, 15, 15, 14, 15, 15], [2, 14, 2, 15, 13, 14, 13, 15], [4, 14, 4, 15, 11, 14, 11, 15], [6, 14, 6, 15, 9, 14, 9, 15], [80, 14, 80, 15, 95, 14, 95, 15], [82, 14, 82, 15, 93, 14, 93, 15], [84, 14, 84, 15, 91, 14, 91, 15], [86, 14, 86, 15, 89, 14, 89, 15], [1, 15, 0, 0, 2, 15, 0, 0], [3, 15, 0, 0, 4, 15, 0, 0], [5, 15, 0, 0, 6, 15, 0, 0], [9, 15, 0, 0, 8, 15, 0, 0], [11, 15, 0, 0, 10, 15, 0, 0], [13, 15, 0, 0, 12, 15, 0, 0], [15, 15, 0, 0, 14, 15, 0, 0], [17, 15, 0, 0, 18, 15, 0, 0], [19, 15, 0, 0, 20, 15, 0, 0], [21, 15, 0, 0, 22, 15, 0, 0], [25, 15, 0, 0, 24, 15, 0, 0], [27, 15, 0, 0, 26, 15, 0, 0], [29, 15, 0, 0, 28, 15, 0, 0], [31, 15, 0, 0, 30, 15, 0, 0], [33, 15, 0, 0, 34, 15, 0, 0], [35, 15, 0, 0, 36, 15, 0, 0], [37, 15, 0, 0, 38, 15, 0, 0], [41, 15, 0, 0, 40, 15, 0, 0], [43, 15, 0, 0, 42, 15, 0, 0], [45, 15, 0, 0, 44, 15, 0, 0], [47, 15, 0, 0, 46, 15, 0, 0], [49, 15, 0, 0, 50, 15, 0, 0], [51, 15, 0, 0, 52, 15, 0, 0], [53, 15, 0, 0, 54, 15, 0, 0], [57, 15, 0, 0, 56, 15, 0, 0], [59, 15, 0, 0, 58, 15, 0, 0], [61, 15, 0, 0, 60, 15, 0, 0], [63, 15, 0, 0, 62, 15, 0, 0], [65, 15, 0, 0, 66, 15, 0, 0], [67, 15, 0, 0, 68, 15, 0, 0], [69, 15, 0, 0, 70, 15, 0, 0], [73, 15, 0, 0, 72, 15, 0, 0], [75, 15, 0, 0, 74, 15, 0, 0], [77, 15, 0, 0, 76, 15, 0, 0], [79, 15, 0, 0, 78, 15, 0, 0], [81, 15, 0, 0, 82, 15, 0, 0], [83, 15, 0, 0, 84, 15, 0, 0], [85, 15, 0, 0, 86, 15, 0, 0], [89, 15, 0, 0, 88, 15, 0, 0], [91, 15, 0, 0, 90, 15, 0, 0], [93, 15, 0, 0, 92, 15, 0, 0], [95, 15, 0, 0, 94, 15, 0, 0], [7, 15, 0, 0, 7, 13, 7, 14, 6, 13, 6, 14], [23, 15, 0, 0, 23, 13, 23, 14, 22, 13, 22, 14], [39, 15, 0, 0, 39, 13, 39, 14, 38, 13, 38, 14], [55, 15, 0, 0, 55, 13, 55, 14, 54, 13, 54, 14], [71, 15, 0, 0, 71, 13, 71, 14, 70, 13, 70, 14], [87, 15, 0, 0, 87, 13, 87, 14, 86, 13, 86, 14]

The oligonucleotide sequences used to produce 4H×24H×120B nucleic acid structures of the invention are designated SEQ ID NOs. 5672-6355, and the corresponding 5' end coordinates are shown respectively in Table 30. (See also Appendix, Table 12 of U.S. provisional application No. 61/675,309, filed Jul. 24, 2012, incorporated by reference herein.)

TABLE 30

[1, 23], [1, 39], [1, 55], [1, 71], [1, 87], [1, 103], [1, 119], [1, 135], [3, 39], [3, 71], [3, 103], [3, 135], [4, 8], [5, 23], [5, 39], [5, 55], [5, 71], [5, 87], [5, 103], [5, 119], [5, 135], [7, 23], [7, 55], [7, 87], [7, 119], [7, 135], [9, 23], [9, 39], [9, 55], [9, 71], [9, 87], [9, 103], [9, 119], [9, 135], [11, 39], [11, 71], [11, 103], [11, 135], [12, 8], [13, 23], [13, 39], [13, 55], [13, 71], [13, 87], [13, 103], [13, 119], [13, 135], [15, 23], [15, 55], [15, 87], [15, 119], [15, 135], [17, 23], [17, 39], [17, 55], [17, 71], [17, 87], [17, 103], [17, 119], [17, 135], [19, 39], [19, 71], [19, 103], [19, 135], [20, 8], [21, 23], [21, 39], [21, 55], [21, 71], [21, 87], [21, 103], [21, 119], [21, 135], [23, 23], [23, 55], [23, 87], [23, 119], [23, 135], [25, 23], [25, 39], [25, 55], [25, 71], [25, 87], [25, 103], [25, 119], [25, 135], [27, 39], [27, 71], [27, 103], [27, 135], [28, 8], [29, 23], [29, 39], [29, 55], [29, 71], [29, 87], [29, 103], [29, 119], [29, 135], [31, 23], [31, 55], [31, 87], [31, 119], [31, 135], [33, 23], [33, 39], [33, 55], [33, 71], [33, 87], [33, 103], [33, 119], [33, 135], [35, 39], [35, 71], [35, 103], [35, 135], [36, 8], [37, 23], [37, 39], [37, 55], [37, 71], [37, 87], [37, 103], [37, 119], [37, 135], [39, 23], [39, 55], [39, 87], [39, 119], [39, 135], [41, 23], [41, 39], [41, 55], [41, 71], [41, 87], [41, 103], [41, 119], [41, 135], [43, 39], [43, 71], [43, 103], [43, 135], [44, 8], [45, 23], [45, 39], [45, 55], [45, 71], [45, 87], [45, 103], [45, 119], [45, 135], [47, 23], [47, 55], [47, 87], [47, 119], [47, 135], [49, 23], [49, 39], [49, 55], [49, 71], [49, 87], [49, 103], [49, 119], [49, 135], [51, 39], [51, 71], [51, 103], [51, 135], [52, 8], [53, 23], [53, 39], [53, 55], [53, 71], [53, 87], [53, 103], [53, 119], [53, 135], [55, 23], [55, 55], [55, 87], [55, 119], [55, 135], [57, 23], [57, 39], [57, 55], [57, 71], [57, 87], [57, 103], [57, 119], [57, 135], [59, 39], [59, 71], [59, 103], [59, 135], [60, 8], [61, 23], [61, 39], [61, 55], [61, 71], [61, 87], [61, 103], [61, 119], [61, 135], [63, 23], [63, 55], [63, 87], [63, 119], [63, 135], [65, 23], [65, 39], [65, 55], [65, 71], [65, 87], [65, 103], [65, 119], [65, 135], [67, 39], [67, 71], [67, 103], [67, 135], [68, 8], [69, 23], [69, 39], [69, 55], [69, 71], [69, 87], [69, 103], [69, 119], [69, 135], [71, 23], [71, 55], [71, 87], [71, 119], [71, 135], [73, 23], [73, 39], [73, 55], [73, 71], [73, 87], [73, 103], [73, 119], [73, 135], [75, 39], [75, 71], [75, 103], [75, 135], [76, 8], [77, 23], [77, 39], [77, 55], [77, 71], [77, 87], [77, 103], [77, 119], [77, 135], [79, 23], [79, 55], [79, 87], [79, 119], [79, 135], [81, 23], [81, 39], [81, 55], [81, 71], [81, 87], [81, 103], [81, 119], [81, 135], [83, 39], [83, 71], [83, 103], [83, 135], [84, 8], [85, 23], [85, 39], [85, 55], [85, 71], [85, 87], [85, 103], [85, 119], [85, 135], [87, 23], [87, 55], [87, 87], [87, 119], [87, 135], [89, 23], [89, 39], [89, 55], [89, 71], [89, 87], [89, 103], [89, 119], [89, 135], [91, 39], [91, 71], [91, 103], [91, 135], [92, 8], [93, 23], [93, 39], [93, 55], [93, 71], [93, 87], [93, 103], [93, 119], [93, 135], [95, 23], [95, 55], [95, 87], [95, 119], [95, 135], [0, 47], [0, 79], [0, 111], [0, 143], [1, 16], [2, 47], [2, 79], [2, 111], [2, 143], [3, 16], [4, 31], [4, 47], [4, 63], [4, 79], [4, 95], [4, 111], [4, 127], [4, 143], [6, 31], [6, 47], [6, 63], [6, 79], [6, 95], [6, 111], [6, 127], [6, 143], [8, 31], [8, 47], [8, 63], [8, 79], [8, 95], [8, 111], [8, 127], [8, 143], [10, 31], [10, 47], [10, 63], [10, 79], [10, 95], [10, 111], [10, 127], [10, 143], [12, 31], [12, 47], [12,

TABLE 30-continued

63], [12, 79], [12, 95], [12, 111], [12, 127], [12, 143], [14, 31], [14, 47], [14, 63], [14, 79], [14, 95], [14, 111], [14, 127], [14, 143], [16, 31], [16, 47], [16, 63], [16, 79], [16, 95], [16, 111], [16, 127], [16, 143], [18, 31], [18, 47], [18, 63], [18, 79], [18, 95], [18, 111], [18, 127], [18, 143], [20, 31], [20, 47], [20, 63], [20, 79], [20, 95], [20, 111], [20, 127], [20, 143], [22, 31], [22, 47], [22, 63], [22, 79], [22, 95], [22, 111], [22, 127], [22, 143], [24, 31], [24, 47], [24, 63], [24, 79], [24, 95], [24, 111], [24, 127], [24, 143], [26, 31], [26, 47], [26, 63], [26, 79], [26, 95], [26, 111], [26, 127], [26, 143], [28, 31], [28, 47], [28, 63], [28, 79], [28, 95], [28, 111], [28, 127], [28, 143], [30, 31], [30, 47], [30, 63], [30, 79], [30, 95], [30, 111], [30, 127], [30, 143], [32, 31], [32, 47], [32, 63], [32, 79], [32, 95], [32, 111], [32, 127], [32, 143], [34, 31], [34, 47], [34, 63], [34, 79], [34, 95], [34, 111], [34, 127], [34, 143], [36, 31], [36, 47], [36, 63], [36, 79], [36, 95], [36, 111], [36, 127], [36, 143], [38, 31], [38, 47], [38, 63], [38, 79], [38, 95], [38, 111], [38, 127], [38, 143], [40, 31], [40, 47], [40, 63], [40, 79], [40, 95], [40, 111], [40, 127], [40, 143], [42, 31], [42, 47], [42, 63], [42, 79], [42, 95], [42, 111], [42, 127], [42, 143], [44, 31], [44, 47], [44, 63], [44, 79], [44, 95], [44, 111], [44, 127], [44, 143], [46, 31], [46, 47], [46, 63], [46, 79], [46, 95], [46, 111], [46, 127], [46, 143], [48, 31], [48, 47], [48, 63], [48, 79], [48, 95], [48, 111], [48, 127], [48, 143], [50, 31], [50, 47], [50, 63], [50, 79], [50, 95], [50, 111], [50, 127], [50, 143], [52, 31], [52, 47], [52, 63], [52, 79], [52, 95], [52, 111], [52, 127], [52, 143], [54, 31], [54, 47], [54, 63], [54, 79], [54, 95], [54, 111], [54, 127], [54, 143], [56, 31], [56, 47], [56, 63], [56, 79], [56, 95], [56, 111], [56, 127], [56, 143], [58, 31], [58, 47], [58, 63], [58, 79], [58, 95], [58, 111], [58, 127], [58, 143], [60, 31], [60, 47], [60, 63], [60, 79], [60, 95], [60, 111], [60, 127], [60, 143], [62, 31], [62, 47], [62, 63], [62, 79], [62, 95], [62, 111], [62, 127], [62, 143], [64, 31], [64, 47], [64, 63], [64, 79], [64, 95], [64, 111], [64, 127], [64, 143], [66, 31], [66, 47], [66, 63], [66, 79], [66, 95], [66, 111], [66, 127], [66, 143], [68, 31], [68, 47], [68, 63], [68, 79], [68, 95], [68, 111], [68, 127], [68, 143], [70, 31], [70, 47], [70, 63], [70, 79], [70, 95], [70, 111], [70, 127], [70, 143], [72, 31], [72, 47], [72, 63], [72, 79], [72, 95], [72, 111], [72, 127], [72, 143], [74, 31], [74, 47], [74, 63], [74, 79], [74, 95], [74, 111], [74, 127], [74, 143], [76, 31], [76, 47], [76, 63], [76, 79], [76, 95], [76, 111], [76, 127], [76, 143], [78, 31], [78, 47], [78, 63], [78, 79], [78, 95], [78, 111], [78, 127], [78, 143], [80, 31], [80, 47], [80, 63], [80, 79], [80, 95], [80, 111], [80, 127], [80, 143], [82, 31], [82, 47], [82, 63], [82, 79], [82, 95], [82, 111], [82, 127], [82, 143], [84, 31], [84, 47], [84, 63], [84, 79], [84, 95], [84, 111], [84, 127], [84, 143], [86, 31], [86, 47], [86, 63], [86, 79], [86, 95], [86, 111], [86, 127], [86, 143], [88, 31], [88, 47], [88, 63], [88, 79], [88, 95], [88, 111], [88, 127], [88, 143], [90, 31], [90, 47], [90, 63], [90, 79], [90, 95], [90, 111], [90, 127], [90, 143], [92, 31], [92, 63], [92, 95], [92, 127], [92, 143], [94, 31], [94, 63], [94, 95], [94, 127], [94, 143]

The oligonucleotide sequences used to produce 12H×12H×48B nucleic acid structures of the invention are designated SEQ ID NOs. 6356-6841, and the corresponding 5' coordinates are shown respectively in Table 31. (See also Appendix, Table 13 of U.S. provisional application No. 61/675,309, filed Jul. 24, 2012, incorporated by reference herein.)

The oligonucleotide sequences used to produce the shapes of FIG. 3E from a 10×10×10 voxel 3D canvas are designated SEQ ID NOs. 6842-11296 (strands 0-4454, respectively), and the corresponding voxel coordinates are shown respectively in Table 32. (See also Appendix, Table 14 of U.S. provisional application No. 61/675,309, filed Jul. 24, 2012, incorporated by reference herein.)

TABLE 31

[1, 23], [1, 55], [1, 39], [3, 23], [3, 55], [3, 39], [5, 23], [5, 55], [5, 39], [7, 23], [7, 55], [7, 39], [9, 23], [9, 55], [9, 39], [11, 39], [11, 55], [12, 8], [13, 39], [13, 23], [13, 55], [15, 39], [15, 23], [15, 55], [17, 39], [17, 23], [17, 55], [19, 39], [19, 23], [19, 55], [21, 39], [21, 23], [21, 55], [23, 55], [23, 23], [25, 23], [25, 55], [25, 39], [27, 23], [27, 55], [27, 39], [29, 23], [29, 55], [29, 39], [31, 23], [31, 55], [31, 39], [33, 23], [33, 55], [33, 39], [35, 39], [35, 55], [36, 8], [37, 39], [37, 23], [37, 55], [39, 39], [39, 23], [39, 55], [41, 39], [41, 23], [41, 55], [43, 39], [43, 23], [43, 55], [45, 39], [45, 23], [45, 55], [47, 55], [47, 23], [49, 23], [49, 55], [49, 39], [51, 23], [51, 55], [51, 39], [53, 23], [53, 55], [53, 39], [55, 23], [55, 55], [55, 39], [57, 23], [57, 55], [57, 39], [59, 39], [59, 55], [60, 8], [61, 39], [61, 23], [61, 55], [63, 39], [63, 23], [63, 55], [65, 39], [65, 23], [65, 55], [67, 39], [67, 23], [67, 55], [69, 39], [69, 23], [69, 55], [71, 55], [71, 23], [73, 23], [73, 55], [73, 39], [75, 23], [75, 55], [75, 39], [77, 23], [77, 55], [77, 39], [79, 23], [79, 55], [79, 39], [81, 23], [81, 55], [81, 39], [83, 39], [83, 55], [84, 8], [85, 39], [85, 23], [85, 55], [87, 39], [87, 23], [87, 55], [89, 39], [89, 23], [89, 55], [91, 39], [91, 23], [91, 55], [93, 39], [93, 23], [93, 55], [95, 55], [95, 23], [97, 23], [97, 55], [97, 39], [99, 23], [99, 55], [99, 39], [101, 23], [101, 55], [101, 39], [103, 23], [103, 55], [103, 39], [105, 23], [105, 55], [105, 39], [107, 39], [107, 55], [108, 8], [109, 39], [109, 23], [109, 55], [111, 39], [111, 23], [111, 55], [113, 39], [113, 23], [113, 55], [115, 39], [115, 23], [115, 55], [117, 39], [117, 23], [117, 55], [119, 55], [119, 23], [121, 23], [121, 55], [121, 39], [123, 23], [123, 55], [123, 39], [125, 23], [125, 55], [125, 39], [127, 23], [127, 55], [127, 39], [129, 23], [129, 55], [129, 39], [131, 39], [131, 55], [132, 8], [133, 39], [133, 23], [133, 55], [135, 39], [135, 23], [135, 55], [137, 39], [137, 23], [137, 55], [139, 39], [139, 23], [139, 55], [141, 39], [141, 23], [141, 55], [143, 55], [143, 23], [0, 15], [2, 15], [4, 15], [6, 15], [8, 15], [10, 15], [0, 47], [0, 63], [2, 47], [2, 63], [4, 47], [4, 63], [6, 47], [6, 63], [8, 47], [8, 63], [10, 47], [10, 63], [12, 15], [12, 47], [14, 15], [14, 47], [16, 15], [16, 47], [18, 15], [18, 47], [20, 15], [20, 47], [22, 15], [22, 47], [12, 31], [12, 63], [14, 31], [14, 63], [16, 31], [16, 63], [18, 31], [18, 63], [20, 31], [20, 63], [22, 31], [22, 63], [24, 15], [24, 47], [26, 15], [26, 47], [28, 15], [28, 47], [30, 15], [30, 47], [32, 15], [32, 47], [34, 15], [34, 47], [24, 31], [24, 63], [26, 31], [26, 63], [28, 31], [28, 63], [30, 31], [30, 63], [32, 31], [32, 63], [34, 31], [34, 63], [36, 15], [36, 47], [38, 15], [38, 47], [40, 15], [40, 47], [42, 15], [42, 47], [44, 15], [44, 47], [46, 15], [46, 47], [36, 31], [36, 63], [38, 31], [38, 63], [40, 31], [40, 63], [42, 31], [42, 63], [44, 31], [44, 63], [46, 31], [46, 63], [48, 15], [48, 47], [50, 15], [50, 47], [52, 15], [52, 47], [54, 15], [54, 47], [56, 15], [56, 47], [58, 15], [58, 47], [48, 31], [48, 63], [50, 31], [50, 63], [52, 31], [52, 63], [54, 31], [54, 63], [56, 31], [56, 63], [58, 31], [58, 63], [60, 15], [60, 47], [62, 15], [62, 47], [64, 15], [64, 47], [66, 15], [66, 47], [68, 15], [68, 47], [70, 15], [70, 47], [60, 31], [60, 63], [62, 31], [62, 63], [64, 31], [64, 63], [66, 31], [66, 63], [68, 31], [68, 63], [70, 31], [70, 63], [72, 15], [72, 47], [74, 15], [74, 47], [76, 15], [76, 47], [78, 15], [78, 47], [80, 15], [80, 47], [82, 15], [82, 47], [72, 31], [72, 63], [74, 31], [74, 63], [76, 31], [76, 63], [78, 31], [78, 63], [80, 31], [80, 63], [82, 31], [82, 63], [84, 15], [84, 47], [86, 15], [86, 47], [88, 15], [88, 47], [90, 15], [90, 47], [92, 15], [92, 47], [94, 15], [94, 47], [84, 31], [84, 63], [86, 31], [86, 63], [88, 31], [88, 63], [90, 31], [90, 63], [92, 31], [92, 63], [94, 31], [94, 63], [96, 15], [96, 47], [98, 15], [98, 47], [100, 15], [100, 47], [102, 15], [102, 47], [104, 15], [104, 47], [106, 15], [106, 47], [96, 31], [96, 63], [98, 31], [98, 63], [100, 31], [100, 63], [102, 31], [102, 63], [104, 31], [104, 63], [106, 31], [106, 63], [108, 15], [108, 47], [110, 15], [110, 47], [112, 15], [112, 47], [114, 15], [114, 47], [116, 15], [116, 47], [118, 15], [118, 47], [108, 31], [108, 63], [110, 31], [110, 63], [112, 31], [112, 63], [114, 31], [114, 63], [116, 31], [116, 63], [118, 31], [118, 63], [120, 15], [120, 47], [122, 15], [122, 47], [124, 15], [124, 47], [126, 15], [126, 47], [128, 15], [128, 47], [130, 15], [130, 47], [120, 31], [120, 63], [122, 31], [122, 63], [124, 31], [124, 63], [126, 31], [126, 63], [128, 31], [128, 63], [130, 31], [130, 63], [132, 31], [132, 63], [134, 31], [134, 63], [136, 31], [136, 63], [138, 31], [138, 63], [140, 31], [140, 63], [142, 31], [142, 63], [133, 0], [135, 0], [137, 0], [139, 0], [141, 0], [143, 0]

TABLE 32

[1, 1, 1, 2, 0, 1, 0, 2], [1, 3, 1, 4, 2, 3, 2, 4], [1, 5, 1, 6, 0, 5, 0, 6], [1, 7, 1, 8, 2, 7, 2, 8], [1, 9, 1, 10, 0, 9, 0, 10], [3, 1, 3, 2, 2, 1, 2, 2], [3, 3, 3, 4, 4, 3, 4, 4], [3, 5, 3, 6, 2, 5, 2, 6], [3, 7, 3, 8, 4, 7, 4, 8], [3, 9, 3, 10, 2, 9, 2, 10], [5, 1, 5, 2, 4, 1, 4, 2], [5, 3, 5, 4, 6, 3, 6, 4], [5, 5, 5, 6, 4, 5, 4, 6], [5, 7, 5, 8, 6, 7, 6, 8], [5, 9, 5, 10, 4, 9, 4, 10], [7, 1, 7, 2, 6, 1, 6, 2], [7, 3, 7, 4, 8, 3, 8, 4], [7, 5, 7, 6, 6, 5, 6, 6], [7, 7, 7, 8, 8, 7, 8, 8], [7, 9, 7, 10, 6, 9, 6, 10], [9, 1, 9, 2, 8, 1, 8, 2], [9, 5, 9, 6, 8, 5, 8, 6], [9, 9, 9, 10, 8, 9, 8, 10], [11, 1, 11, 2, 12, 1, 12, 2], [11, 3, 11, 4, 10, 3, 10, 4], [11, 5, 11, 6, 12, 5, 12, 6], [11, 7, 11, 8, 10, 7, 10, 8], [11, 9, 11, 10, 12, 9, 12, 10], [13, 1, 13, 2, 14, 1, 14, 2], [13, 3, 13, 4, 12, 3, 12, 4], [13, 5, 13, 6, 14, 5, 14, 6], [13, 7, 13, 8, 12, 7, 12, 8], [13, 9, 13, 10, 14, 9, 14, 10], [15, 1, 15, 2, 16, 1, 16, 2], [15, 3, 15, 4, 14, 3, 14, 4], [15, 5, 15, 6, 16, 5, 16, 6], [15, 7, 15, 8, 14, 7, 14, 8], [15, 9, 15, 10, 16, 9, 16, 10], [17, 1, 17, 2, 18, 1, 18, 2], [17, 3, 17, 4, 16, 3, 16, 4], [17, 5, 17, 6, 18, 5, 18, 6], [17, 7, 17, 8, 16, 7, 16, 8], [17, 9, 17, 10, 18, 9, 18, 10], [19, 3, 19, 4, 18, 3, 18, 4], [19, 7, 19, 8, 18, 7, 18, 8], [21, 1, 21, 2, 20, 1, 20, 2], [21, 3, 21, 4, 22, 3, 22, 4], [21, 5, 21, 6, 20, 5, 20, 6], [21, 7, 21, 8, 22, 7, 22, 8], [21, 9, 21, 10, 20, 9, 20, 10], [23, 1, 23, 2, 22, 1, 22, 2], [23, 3, 23, 4, 24, 3, 24, 4], [23, 5, 23, 6, 22, 5, 22, 6], [23, 7, 23, 8, 24, 7, 24, 8], [23, 9, 23, 10, 22, 9, 22, 10], [25, 1, 25, 2, 24, 1, 24, 2], [25, 3, 25, 4, 26, 3, 26, 4], [25, 5, 25, 6, 24, 5, 24, 6], [25, 7, 25, 8, 26, 7, 26, 8], [25, 9, 25, 10, 24, 9, 24, 10], [27, 1, 27, 2, 26, 1, 26, 2], [27, 3, 27, 4, 28, 3, 28, 4], [27, 5, 27, 6, 26, 5, 26, 6], [27, 7, 27, 8, 28, 7, 28, 8], [27, 9, 27, 10, 26, 9, 26, 10], [29, 1, 29, 2, 28, 1, 28, 2], [29, 5, 29, 6, 28, 5, 28, 6], [29, 9, 29, 10, 28, 9, 28, 10], [31, 1, 31, 2, 32, 1, 32, 2], [31, 3, 31, 4, 30, 3, 30, 4], [31, 5, 31, 6, 32, 5, 32, 6], [31, 7, 31, 8, 30, 7, 30, 8], [31, 9, 31, 10, 32, 9, 32, 10], [33, 1, 33, 2, 34, 1, 34, 2], [33, 3, 33, 4, 32, 3, 32, 4], [33, 5, 33, 6, 34, 5, 34, 6], [33, 7, 33, 8, 32, 7, 32, 8], [33, 9, 33, 10, 34, 9, 34, 10], [35, 1, 35, 2, 36, 1, 36, 2], [35, 3, 35, 4, 34, 3, 34, 4], [35, 5, 35, 6, 36, 5, 36, 6], [35, 7, 35, 8, 34, 7, 34, 8], [35, 9, 35, 10, 36, 9, 36, 10], [37, 1, 37, 2, 38, 1, 38, 2], [37, 3, 37, 4, 36, 3, 36, 4], [37, 5, 37, 6, 38, 5, 38, 6], [37, 7, 37, 8, 36, 7, 36, 8], [37, 9, 37, 10, 38, 9, 38, 10], [39, 3, 39, 4, 38, 3, 38, 4], [39, 7, 39, 8, 38, 7, 38, 8], [41, 1, 41, 2, 40, 1, 40, 2], [41, 3, 41, 4, 42, 3, 42, 4], [41, 5, 41, 6, 40, 5, 40, 6], [41, 7, 41, 8, 42, 7, 42, 8], [41, 9, 41, 10, 40, 9, 40, 10], [43, 1, 43, 2, 42, 1, 42, 2], [43, 3, 43, 4, 44, 3, 44, 4], [43, 5, 43, 6, 42, 5, 42, 6], [43, 7, 43, 8, 44, 7, 44, 8], [43, 9, 43, 10, 42, 9, 42, 10], [45, 1, 45, 2, 44, 1, 44, 2], [45, 3, 45, 4, 46, 3, 46, 4], [45, 5, 45, 6, 44, 5, 44, 6], [45, 7, 45, 8, 46, 7, 46, 8], [45, 9, 45, 10, 44, 9, 44, 10], [47, 1, 47, 2, 46, 1, 46, 2], [47, 3, 47, 4, 48, 3, 48, 4], [47, 5, 47, 6, 46, 5, 46, 6], [47, 7, 47, 8, 48, 7, 48, 8], [47, 9, 47, 10, 46, 9, 46, 10], [49, 1, 49, 2, 48, 1, 48, 2], [49, 5, 49, 6, 48, 5, 48, 6], [49, 9, 49, 10, 48, 9, 48, 10], [51, 1, 51, 2, 52, 1, 52, 2], [51, 3, 51, 4, 50, 3, 50, 4], [51, 5, 51, 6, 52, 5, 52, 6], [51, 7, 51, 8, 50, 7, 50, 8], [51, 9, 51, 10, 52, 9, 52, 10], [53, 1, 53, 2, 54, 1, 54, 2], [53, 3, 53, 4, 52, 3, 52, 4], [53, 5, 53, 6, 54, 5, 54, 6], [53, 7, 53, 8, 52, 7, 52, 8], [53, 9, 53, 10, 54, 9, 54, 10], [55, 1, 55, 2, 56, 1, 56, 2], [55, 3, 55, 4, 54, 3, 54, 4], [55, 5, 55, 6, 56, 5, 56, 6], [55, 7, 55, 8, 54, 7, 54, 8], [55, 9, 55, 10, 56, 9, 56, 10], [57, 1, 57, 2, 58, 1, 58, 2], [57, 3, 57, 4, 56, 3, 56, 4], [57, 5, 57, 6, 58, 5, 58, 6], [57, 7, 57, 8, 56, 7, 56, 8], [57, 9, 57, 10, 58, 9, 58, 10], [59, 3, 59, 4, 58, 3, 58, 4], [59, 7, 59, 8, 58, 7, 58, 8], [61, 1, 61, 2, 60, 1, 60, 2], [61, 3, 61, 4, 62, 3, 62, 4], [61, 5, 61, 6, 60, 5, 60, 6], [61, 7, 61, 8, 62, 7, 62, 8], [61, 9, 61, 10, 60, 9, 60, 10], [63, 1, 63, 2, 62, 1, 62, 2], [63, 3, 63, 4, 64, 3, 64, 4], [63, 5, 63, 6, 62, 5, 62, 6], [63, 7, 63, 8, 64, 7, 64, 8], [63, 9, 63, 10, 62, 9, 62, 10], [65, 1, 65, 2, 64, 1, 64, 2], [65, 3, 65, 4, 66, 3, 66, 4], [65, 5, 65, 6, 64, 5, 64, 6], [65, 7, 65, 8, 66, 7, 66, 8], [65, 9, 65, 10, 64, 9, 64, 10], [67, 1, 67, 2, 66, 1, 66, 2], [67, 3, 67, 4, 68, 3, 68, 4], [67, 5, 67, 6, 66, 5, 66, 6], [67, 7, 67, 8, 68, 7, 68, 8], [67, 9, 67, 10, 66, 9, 66, 10], [69, 1, 69, 2, 68, 1, 68, 2], [69, 5, 69, 6, 68, 5, 68, 6], [69, 9, 69, 10, 68, 9, 68, 10], [71, 1, 71, 2, 72, 1, 72, 2], [71, 3, 71, 4, 70, 3, 70, 4], [71, 5, 71, 6, 72, 5, 72, 6], [71, 7, 71, 8, 70, 7, 70, 8], [71, 9, 71, 10, 72, 9, 72, 10], [73, 1, 73, 2, 74, 1, 74, 2], [73, 3, 73, 4, 72, 3, 72, 4], [73, 5, 73, 6, 74, 5, 74, 6], [73, 7, 73, 8, 72, 7, 72, 8], [73, 9, 73, 10, 74, 9, 74, 10], [75, 1, 75, 2, 76, 1, 76, 2], [75, 3, 75, 4, 74, 3, 74, 4], [75, 5, 75, 6, 76, 5, 76, 6], [75, 7, 75, 8, 74, 7, 74, 8], [75, 9, 75, 10, 76, 9, 76, 10], [77, 1, 77, 2, 78, 1, 78, 2], [77, 3, 77, 4, 76, 3, 76, 4], [77, 5, 77, 6, 78, 5, 78, 6], [77, 7, 77, 8, 76, 7, 76, 8], [77, 9, 77, 10, 78, 9, 78, 10], [79, 3, 79, 4, 78, 3, 78, 4], [79, 7, 79, 8, 78, 7, 78, 8], [81, 1, 81, 2, 80, 1, 80, 2], [81, 3, 81, 4, 82, 3, 82, 4], [81, 5, 81, 6, 80, 5, 80, 6], [81, 7, 81, 8, 82, 7, 82, 8], [81, 9, 81, 10, 80, 9, 80, 10], [83, 1, 83, 2, 82, 1, 82, 2], [83, 3, 83, 4, 84, 3, 84, 4], [83, 5, 83, 6, 82, 5, 82, 6], [83, 7, 83, 8, 84, 7, 84, 8], [83, 9, 83, 10, 82, 9, 82, 10], [85, 1, 85, 2, 84, 1, 84, 2], [85, 3, 85, 4, 86, 3, 86, 4], [85, 5, 85, 6, 84, 5, 84, 6], [85, 7, 85, 8, 86, 7, 86, 8], [85, 9, 85, 10, 84, 9, 84, 10], [87, 1, 87, 2, 86, 1, 86, 2], [87, 3, 87, 4, 88, 3, 88, 4], [87, 5, 87, 6, 86, 5, 86, 6], [87, 7, 87, 8, 88, 7, 88, 8], [87, 9, 87, 10, 86, 9, 86, 10], [89, 1, 89, 2, 88, 1, 88, 2], [89, 5, 89, 6, 88, 5, 88, 6], [89, 9, 89, 10, 88, 9, 88, 10], [91, 1, 91, 2, 92, 1, 92, 2], [91, 3, 91, 4, 90, 3, 90, 4], [91, 5, 91, 6, 92, 5, 92, 6], [91, 7, 91, 8, 90, 7, 90, 8], [91, 9, 91, 10, 92, 9, 92, 10], [93, 1, 93, 2, 94, 1, 94, 2], [93, 3, 93, 4, 92, 3, 92, 4], [93, 5, 93, 6, 94, 5, 94, 6], [93, 7, 93, 8, 92, 7, 92, 8], [93, 9, 93, 10, 94, 9, 94, 10], [95, 1, 95, 2, 96, 1, 96, 2], [95, 3, 95, 4, 94, 3, 94, 4], [95, 5, 95, 6, 96, 5, 96, 6], [95, 7, 95, 8, 94, 7, 94, 8], [95, 9, 95, 10, 96, 9, 96, 10], [97, 1, 97, 2, 98, 1, 98, 2], [97, 3, 97, 4, 96, 3, 96, 4], [97, 5, 97, 6, 98, 5, 98, 6], [97, 7, 97, 8, 96, 7, 96, 8], [97, 9, 97, 10, 98, 9, 98, 10], [99, 3, 99, 4, 98, 3, 98, 4], [99, 7, 99, 8, 98, 7, 98, 8], [0, 2, 0, 3, 19, 2, 19, 3], [0, 6, 0, 7, 19, 6, 19, 7], [2, 2, 2, 3, 17, 2, 17, 3], [2, 6, 2, 7, 17, 6, 17, 7], [2, 10, 0, 0, 17, 10, 0, 0], [4, 2, 4, 3, 15, 2, 15, 3], [4, 6, 4, 7, 15, 6, 15, 7], [4, 10, 0, 0, 15, 10, 0, 0], [6, 2, 6, 3, 13, 2, 13, 3], [6, 6, 6, 7, 13, 6, 13, 7], [6, 10, 0, 0, 13, 10, 0, 0], [8, 2, 8, 3, 11, 2, 11, 3], [8, 6, 8, 7, 11, 6, 11, 7], [8, 10, 0, 0, 11, 10, 0, 0], [0, 0, 10, 1, 0, 0, 9, 1], [10, 2, 10, 3, 29, 2, 29, 3], [10, 4, 10, 5, 9, 4, 9, 5], [10, 6, 10, 7, 29, 6, 29, 7], [10, 8, 10, 9, 9, 8, 9, 9], [10, 10, 0, 0, 29, 10, 0, 0], [0, 0, 12, 1, 0, 0, 7, 1], [12, 2, 12, 3, 27, 2, 27, 3], [12, 4, 12, 5, 7, 4, 7, 5], [12, 6, 12, 7, 27, 6, 27, 7], [12, 8, 12, 9, 7, 8, 7, 9], [12, 10, 0, 0, 27, 10, 0, 0], [0, 0, 14, 1, 0, 0, 5, 1], [14, 2, 14, 3, 25, 2, 25, 3], [14, 4, 14, 5, 5, 4, 5, 5], [14, 6, 14, 7, 25, 6, 25, 7], [14, 8, 14, 9, 5, 8, 5, 9], [14, 10, 0, 0, 25, 10, 0, 0], [0, 0, 16, 1, 0, 0, 3, 1], [16, 2, 16, 3, 23, 2, 23, 3], [16, 4, 16, 5, 3, 4, 3, 5], [16, 6, 16, 7, 23, 6, 23, 7], [16, 8, 16, 9, 3, 8, 3, 9], [16, 10, 0, 0, 23, 10, 0, 0], [0, 0, 18, 1, 0, 0, 1, 1], [18, 2, 18, 3, 21, 2, 21, 3], [18, 4, 18, 5, 1, 4, 1, 5], [18, 6, 18, 7, 21, 6, 21, 7], [18, 8, 18, 9, 1, 8, 1, 9], [18, 10, 0, 0, 21, 10, 0, 0], [0, 0, 20, 1, 0, 0, 19, 1], [20, 2, 20, 3, 39, 2, 39, 3], [20, 4, 20, 5, 19, 4, 19, 5], [20, 6, 20, 7, 39, 6, 39, 7], [20, 8, 20, 9, 19, 8, 19, 9], [20, 10, 0, 0, 39, 10, 0, 0], [0, 0, 22, 1, 0, 0, 17, 1], [22, 2, 22, 3, 37, 2, 37, 3], [22, 4, 22, 5, 17, 4, 17, 5], [22, 6, 22, 7, 37, 6, 37, 7], [22, 8, 22, 9, 17, 8, 17, 9], [22, 10, 0, 0, 37, 10, 0, 0], [0, 0, 24, 1, 0, 0, 15, 1], [24, 2, 24, 3, 35, 2, 35, 3], [24, 4, 24, 5, 15, 4, 15, 5], [24, 6, 24, 7, 35, 6, 35, 7], [24, 8, 24, 9, 15, 8, 15, 9], [24, 10, 0, 0, 35, 10, 0, 0], [0, 0, 26, 1, 0, 0, 13, 1], [26, 2, 26, 3, 33, 2, 33, 3], [26, 4, 26, 5, 13, 4, 13, 5], [26, 6, 26, 7, 33, 6, 33, 7], [26, 8, 26, 9, 13, 8, 13, 9], [26, 10, 0, 0, 33, 10, 0, 0], [0, 0, 28, 1, 0, 0, 11, 1], [28, 2, 28, 3, 31, 2, 31, 3], [28, 4, 28, 5, 11, 4, 11, 5], [28, 6, 28, 7, 31, 6, 31, 7], [28, 8, 28, 9, 11, 8, 11, 9], [28, 10, 0, 0, 31, 10, 0, 0], [0, 0, 30, 1, 0, 0, 29, 1], [30, 2, 30, 3, 49, 2, 49, 3], [30, 4, 30, 5, 29, 4, 29, 5], [30, 6, 30, 7, 49, 6, 49, 7], [30, 8, 30, 9, 29, 8, 29, 9], [30, 10, 0, 0, 49, 10, 0, 0], [0, 0, 32, 1, 0, 0, 27, 1], [32, 2, 32, 3, 47, 2, 47, 3], [32, 4, 32, 5, 27, 4, 27, 5], [32, 6, 32, 7, 47, 6, 47, 7], [32, 8, 32, 9, 27, 8, 27, 9], [32, 10, 0, 0, 47, 10, 0, 0], [0, 0, 34, 1, 0, 0, 25, 1], [34, 2, 34, 3, 45, 2, 45, 3], [34, 4, 34, 5, 25, 4, 25, 5], [34, 6, 34, 7, 45, 6, 45, 7], [34, 8, 34, 9, 25, 8, 25, 9], [34, 10, 0, 0, 45, 10, 0, 0], [0, 0, 36, 1, 0, 0, 23, 1], [36, 2, 36, 3, 43, 2, 43, 3], [36, 4, 36, 5, 23, 4, 23, 5], [36, 6, 36, 7, 43, 6, 43, 7], [36, 8, 36, 9, 23, 8, 23, 9], [36, 10, 0, 0, 43, 10, 0, 0], [0, 0, 38, 1, 0, 0, 21, 1], [38, 2, 38, 3, 41, 2, 41, 3], [38, 4, 38, 5, 21, 4, 21, 5], [38, 6, 38, 7, 41, 6, 41, 7], [38, 8, 38, 9, 21, 8, 21, 9], [38, 10, 0, 0, 41, 10, 0, 0], [0, 0, 40, 1, 0, 0, 39, 1], [40, 2, 40, 3, 59, 2, 59, 3], [40, 4, 40, 5, 39, 4, 39, 5], [40, 6, 40, 7, 59, 6, 59, 7], [40, 8, 40, 9, 39, 8, 39, 9], [40, 10, 0, 0, 59, 10, 0, 0], [0, 0, 42, 1, 0, 0, 37, 1], [42, 2, 42, 3, 57, 2, 57, 3], [42, 4, 42, 5, 37, 4, 37, 5], [42, 6, 42, 7, 57, 6, 57, 7], [42, 8, 42, 9, 37, 8, 37, 9], [42, 10, 0, 0, 57, 10, 0, 0], [0, 0, 44, 1, 0, 0, 35, 1], [44, 2, 44, 3, 55, 2, 55, 3], [44, 4, 44, 5, 35, 4, 35, 5], [44, 6, 44, 7, 55, 6, 55, 7], [44, 8, 44, 9, 35, 8, 35, 9], [44, 10, 0, 0, 55, 10, 0, 0], [0, 0, 46, 1, 0, 0, 33, 1], [46, 2, 46, 3, 53, 2, 53, 3], [46, 4, 46, 5, 33, 4, 33, 5], [46, 6, 46, 7, 53, 6, 53, 7], [46, 8, 46, 9, 33, 8, 33, 9], [46, 10, 0, 0, 53, 10, 0, 0], [0, 0, 48, 1, 0, 0, 31, 1], [48, 2, 48, 3, 51, 2, 51, 3], [48, 4, 48, 5, 31, 4, 31, 5], [48, 6, 48, 7, 51, 6, 51, 7], [48, 8, 48, 9, 31, 8, 31, 9], [48, 10, 0, 0, 51, 10, 0, 0], [0, 0, 50, 1, 0, 0, 49, 1], [50, 2, 50, 3, 69, 2, 69, 3], [50, 4, 50, 5, 49, 4, 49, 5], [50, 6, 50, 7, 69, 6, 69, 7], [50, 8, 50, 9, 49, 8, 49, 9], [50, 10, 0, 0, 69, 10, 0, 0], [0, 0, 52, 1, 0, 0, 47, 1], [52, 2, 52, 3, 67, 2, 67, 3], [52, 4, 52, 5, 47, 4, 47, 5], [52, 6, 52, 7, 67, 6, 67, 7], [52, 8, 52, 9, 47, 8, 47, 9], [52, 10, 0, 0, 67, 10, 0, 0], [0, 0, 54, 1, 0, 0, 45, 1], [54, 2, 54, 3, 65, 2, 65, 3], [54, 4, 54, 5, 45, 4, 45, 5], [54, 6, 54, 7, 65, 6, 65, 7], [54, 8, 54, 9, 45, 8, 45, 9], [54, 10, 0, 0, 65, 10, 0, 0], [0, 0, 56, 1, 0, 0, 43, 1], [56, 2, 56, 3, 63, 2, 63, 3], [56, 4, 56, 5, 43, 4, 43, 5], [56, 6, 56, 7, 63, 6, 63, 7], [56, 8, 56, 9, 43, 8, 43, 9], [56, 10, 0, 0, 63, 10, 0, 0], [0, 0, 58, 1, 0, 0, 41, 1], [58, 2, 58, 3, 61, 2, 61, 3], [58, 4, 58, 5, 41, 4, 41, 5], [58, 6, 58, 7, 61, 6, 61, 7], [58, 8, 58, 9, 41, 8, 41, 9], [58, 10, 0, 0, 61, 10, 0, 0], [0, 0, 60, 1, 0, 0, 59, 1], [60, 2, 60, 3, 79, 2, 79, 3], [60, 4, 60, 5, 59, 4, 59, 5], [60, 6, 60, 7, 79, 6, 79, 7], [60, 8, 60, 9, 59, 8, 59, 9], [60, 10, 0, 0, 79, 10, 0, 0], [0, 0, 62, 1, 0, 0, 57, 1], [62, 2, 62, 3, 77, 2, 77, 3], [62, 4, 62, 5, 57, 4, 57, 5], [62, 6, 62, 7, 77, 6, 77, 7], [62, 8, 62, 9, 57, 8, 57, 9], [62, 10, 0, 0, 77, 10, 0, 0], [0, 0, 64, 1, 0, 0, 55, 1], [64, 2, 64, 3, 75, 2, 75, 3], [64, 4, 64, 5, 55,

TABLE 32-continued 4, 55, 5], [64, 6, 64, 7, 75, 6, 75, 7], [64, 8, 64, 9, 55, 8, 55, 9], [64, 10, 0, 0, 75, 10, 0, 0], [0, 0, 66, 1, 0, 0, 53, 1], [66, 2, 66, 3, 73, 2, 73, 3], [66, 4, 66, 5, 53, 4, 53, 5], [66, 6, 66, 7, 73, 6, 73, 7], [66, 8, 66, 9, 53, 8, 53, 9], [66, 10, 0, 0, 73, 10, 0, 0], [0, 0, 68, 1, 0, 0, 51, 1], [68, 2, 68, 3, 71, 2, 71, 3], [68, 4, 68, 5, 51, 4, 51, 5], [68, 6, 68, 7, 71, 6, 71, 7], [68, 8, 68, 9, 51, 8, 51, 9], [68, 10, 0, 0, 71, 10, 0, 0], [0, 0, 70, 1, 0, 0, 69, 1], [70, 2, 70, 3, 89, 2, 89, 3], [70, 4, 70, 5, 69, 4, 69, 5], [70, 6, 70, 7, 89, 6, 89, 7], [70, 8, 70, 9, 69, 8, 69, 9], [70, 10, 0, 0, 89, 10, 0, 0], [0, 0, 72, 1, 0, 0, 67, 1], [72, 2, 72, 3, 87, 2, 87, 3], [72, 4, 72, 5, 67, 4, 67, 5], [72, 6, 72, 7, 87, 6, 87, 7], [72, 8, 72, 9, 67, 8, 67, 9], [72, 10, 0, 0, 87, 10, 0, 0], [0, 0, 74, 1, 0, 0, 65, 1], [74, 2, 74, 3, 85, 2, 85, 3], [74, 4, 74, 5, 65, 4, 65, 5], [74, 6, 74, 7, 85, 6, 85, 7], [74, 8, 74, 9, 65, 8, 65, 9], [74, 10, 0, 0, 85, 10, 0, 0], [0, 0, 76, 1, 0, 0, 63, 1], [76, 2, 76, 3, 83, 2, 83, 3], [76, 4, 76, 5, 63, 4, 63, 5], [76, 6, 76, 7, 83, 6, 83, 7], [76, 8, 76, 9, 63, 8, 63, 9], [76, 10, 0, 0, 83, 10, 0, 0], [0, 0, 78, 1, 0, 0, 61, 1], [78, 2, 78, 3, 81, 2, 81, 3], [78, 4, 78, 5, 61, 4, 61, 5], [78, 6, 78, 7, 81, 6, 81, 7], [78, 8, 78, 9, 61, 8, 61, 9], [78, 10, 0, 0, 81, 10, 0, 0], [0, 0, 80, 1, 0, 0, 79, 1], [80, 2, 80, 3, 99, 2, 99, 3], [80, 4, 80, 5, 79, 4, 79, 5], [80, 6, 80, 7, 99, 6, 99, 7], [80, 8, 80, 9, 79, 8, 79, 9], [80, 10, 0, 0, 99, 10, 0, 0], [0, 0, 82, 1, 0, 0, 77, 1], [82, 2, 82, 3, 97, 2, 97, 3], [82, 4, 82, 5, 77, 4, 77, 5], [82, 6, 82, 7, 97, 6, 97, 7], [82, 8, 82, 9, 77, 8, 77, 9], [82, 10, 0, 0, 97, 10, 0, 0], [0, 0, 84, 1, 0, 0, 75, 1], [84, 2, 84, 3, 95, 2, 95, 3], [84, 4, 84, 5, 75, 4, 75, 5], [84, 6, 84, 7, 95, 6, 95, 7], [84, 8, 84, 9, 75, 8, 75, 9], [84, 10, 0, 0, 95, 10, 0, 0], [0, 0, 86, 1, 0, 0, 73, 1], [86, 2, 86, 3, 93, 2, 93, 3], [86, 4, 86, 5, 73, 4, 73, 5], [86, 6, 86, 7, 93, 6, 93, 7], [86, 8, 86, 9, 73, 8, 73, 9], [86, 10, 0, 0, 93, 10, 0, 0], [0, 0, 88, 1, 0, 0, 71, 1], [88, 2, 88, 3, 91, 2, 91, 3], [88, 4, 88, 5, 71, 4, 71, 5], [88, 6, 88, 7, 91, 6, 91, 7], [88, 8, 88, 9, 71, 8, 71, 9], [88, 10, 0, 0, 91, 10, 0, 0], [0, 0, 90, 1, 0, 0, 89, 1], [90, 4, 90, 5, 89, 4, 89, 5], [90, 8, 90, 9, 89, 8, 89, 9], [0, 0, 92, 1, 0, 0, 87, 1], [92, 4, 92, 5, 87, 4, 87, 5], [92, 8, 92, 9, 87, 8, 87, 9], [0, 0, 94, 1, 0, 0, 85, 1], [94, 4, 94, 5, 85, 4, 85, 5], [94, 8, 94, 9, 85, 8, 85, 9], [0, 0, 96, 1, 0, 0, 83, 1], [96, 4, 96, 5, 83, 4, 83, 5], [96, 8, 96, 9, 83, 8, 83, 9], [0, 0, 98, 1, 0, 0, 81, 1], [98, 4, 98, 5, 81, 4, 81, 5], [98, 8, 98, 9, 81, 8, 81, 9], [1, 1, 1, 2, 0, 0, 0, 0], [0, 1, 0, 2, 0, 0, 0, 0], [1, 3, 1, 4, 0, 0, 0, 0], [2, 3, 2, 4, 0, 0, 0, 0], [1, 5, 1, 6, 0, 0, 0, 0], [0, 5, 0, 6, 0, 0, 0, 0], [1, 7, 1, 8, 0, 0, 0, 0], [2, 7, 2, 8, 0, 0, 0, 0], [1, 9, 1, 10, 0, 0, 0, 0], [0, 9, 0, 10, 0, 0, 0, 0], [3, 1, 3, 2, 0, 0, 0, 0], [2, 1, 2, 2, 0, 0, 0, 0], [3, 3, 3, 4, 0, 0, 0, 0], [4, 3, 4, 4, 0, 0, 0, 0], [3, 5, 3, 6, 0, 0, 0, 0], [2, 5, 2, 6, 0, 0, 0, 0], [3, 7, 3, 8, 0, 0, 0, 0], [4, 7, 4, 8, 0, 0, 0, 0], [3, 9, 3, 10, 0, 0, 0, 0], [2, 9, 2, 10, 0, 0, 0, 0], [5, 1, 5, 2, 0, 0, 0, 0], [4, 1, 4, 2, 0, 0, 0, 0], [5, 3, 5, 4, 0, 0, 0, 0], [6, 3, 6, 4, 0, 0, 0, 0], [5, 5, 5, 6, 0, 0, 0, 0], [4, 5, 4, 6, 0, 0, 0, 0], [5, 7, 5, 8, 0, 0, 0, 0], [6, 7, 6, 8, 0, 0, 0, 0], [5, 9, 5, 10, 0, 0, 0, 0], [4, 9, 4, 10, 0, 0, 0, 0], [7, 1, 7, 2, 0, 0, 0, 0], [6, 1, 6, 2, 0, 0, 0, 0], [7, 3, 7, 4, 0, 0, 0, 0], [8, 3, 8, 4, 0, 0, 0, 0], [7, 5, 7, 6, 0, 0, 0, 0], [6, 5, 6, 6, 0, 0, 0, 0], [7, 7, 7, 8, 0, 0, 0, 0], [8, 7, 8, 8, 0, 0, 0, 0], [7, 9, 7, 10, 0, 0, 0, 0], [6, 9, 6, 10, 0, 0, 0, 0], [9, 1, 9, 2, 0, 0, 0, 0], [8, 1, 8, 2, 0, 0, 0, 0], [9, 5, 9, 6, 0, 0, 0, 0], [8, 5, 8, 6, 0, 0, 0, 0], [9, 9, 9, 10, 0, 0, 0, 0], [8, 9, 8, 10, 0, 0, 0, 0], [11, 1, 11, 2, 0, 0, 0, 0], [12, 1, 12, 2, 0, 0, 0, 0], [11, 3, 11, 4, 0, 0, 0, 0], [10, 3, 10, 4, 0, 0, 0, 0], [11, 5, 11, 6, 0, 0, 0, 0], [12, 5, 12, 6, 0, 0, 0, 0], [11, 7, 11, 8, 0, 0, 0, 0], [10, 7, 10, 8, 0, 0, 0, 0], [11, 9, 11, 10, 0, 0, 0, 0], [12, 9, 12, 10, 0, 0, 0, 0], [13, 1, 13, 2, 0, 0, 0, 0], [14, 1, 14, 2, 0, 0, 0, 0], [13, 3, 13, 4, 0, 0, 0, 0], [12, 3, 12, 4, 0, 0, 0, 0], [13, 5, 13, 6, 0, 0, 0, 0], [14, 5, 14, 6, 0, 0, 0, 0], [13, 7, 13, 8, 0, 0, 0, 0], [12, 7, 12, 8, 0, 0, 0, 0], [13, 9, 13, 10, 0, 0, 0, 0], [14, 9, 14, 10, 0, 0, 0, 0], [15, 1, 15, 2, 0, 0, 0, 0], [16, 1, 16, 2, 0, 0, 0, 0], [15, 3, 15, 4, 0, 0, 0, 0], [14, 3, 14, 4, 0, 0, 0, 0], [15, 5, 15, 6, 0, 0, 0, 0], [16, 5, 16, 6, 0, 0, 0, 0], [15, 7, 15, 8, 0, 0, 0, 0], [14, 7, 14, 8, 0, 0, 0, 0], [15, 9, 15, 10, 0, 0, 0, 0], [16, 9, 16, 10, 0, 0, 0, 0], [17, 1, 17, 2, 0, 0, 0, 0], [18, 1, 18, 2, 0, 0, 0, 0], [17, 3, 17, 4, 0, 0, 0, 0], [16, 3, 16, 4, 0, 0, 0, 0], [17, 5, 17, 6, 0, 0, 0, 0], [18, 5, 18, 6, 0, 0, 0, 0], [17, 7, 17, 8, 0, 0, 0, 0], [16, 7, 16, 8, 0, 0, 0, 0], [17, 9, 17, 10, 0, 0, 0, 0], [18, 9, 18, 10, 0, 0, 0, 0], [19, 3, 19, 4, 0, 0, 0, 0], [18, 3, 18, 4, 0, 0, 0, 0], [19, 7, 19, 8, 0, 0, 0, 0], [18, 7, 18, 8, 0, 0, 0, 0], [21, 1, 21, 2, 0, 0, 0, 0], [20, 1, 20, 2, 0, 0, 0, 0], [21, 3, 21, 4, 0, 0, 0, 0], [22, 3, 22, 4, 0, 0, 0, 0], [21, 5, 21, 6, 0, 0, 0, 0], [20, 5, 20, 6, 0, 0, 0, 0], [21, 7, 21, 8, 0, 0, 0, 0], [22, 7, 22, 8, 0, 0, 0, 0], [21, 9, 21, 10, 0, 0, 0, 0], [20, 9, 20, 10, 0, 0, 0, 0], [23, 1, 23, 2, 0, 0, 0, 0], [22, 1, 22, 2, 0, 0, 0, 0], [23, 3, 23, 4, 0, 0, 0, 0], [24, 3, 24, 4, 0, 0, 0, 0], [23, 5, 23, 6, 0, 0, 0, 0], [22, 5, 22, 6, 0, 0, 0, 0], [23, 7, 23, 8, 0, 0, 0, 0], [24, 7, 24, 8, 0, 0, 0, 0], [23, 9, 23, 10, 0, 0, 0, 0], [22, 9, 22, 10, 0, 0, 0, 0], [25, 1, 25, 2, 0, 0, 0, 0], [24, 1, 24, 2, 0, 0, 0, 0], [25, 3, 25, 4, 0, 0, 0, 0], [26, 3, 26, 4, 0, 0, 0, 0], [25, 5, 25, 6, 0, 0, 0, 0], [24, 5, 24, 6, 0, 0, 0, 0], [25, 7, 25, 8, 0, 0, 0, 0], [26, 7, 26, 8, 0, 0, 0, 0], [25, 9, 25, 10, 0, 0, 0, 0], [24, 9, 24, 10, 0, 0, 0, 0], [27, 1, 27, 2, 0, 0, 0, 0], [26, 1, 26, 2, 0, 0, 0, 0], [27, 3, 27, 4, 0, 0, 0, 0], [28, 3, 28, 4, 0, 0, 0, 0], [27, 5, 27, 6, 0, 0, 0, 0], [26, 5, 26, 6, 0, 0, 0, 0], [27, 7, 27, 8, 0, 0, 0, 0], [28, 7, 28, 8, 0, 0, 0, 0], [27, 9, 27, 10, 0, 0, 0, 0], [26, 9, 26, 10, 0, 0, 0, 0], [29, 1, 29, 2, 0, 0, 0, 0], [28, 1, 28, 2, 0, 0, 0, 0], [29, 5, 29, 6, 0, 0, 0, 0], [28, 5, 28, 6, 0, 0, 0, 0], [29, 9, 29, 10, 0, 0, 0, 0], [28, 9, 28, 10, 0, 0, 0, 0], [31, 1, 31, 2, 0, 0, 0, 0], [32, 1, 32, 2, 0, 0, 0, 0], [31, 3, 31, 4, 0, 0, 0, 0], [30, 3, 30, 4, 0, 0, 0, 0], [31, 5, 31, 6, 0, 0, 0, 0], [32, 5, 32, 6, 0, 0, 0, 0], [31, 7, 31, 8, 0, 0, 0, 0], [30, 7, 30, 8, 0, 0, 0, 0], [31, 9, 31, 10, 0, 0, 0, 0], [32, 9, 32, 10, 0, 0, 0, 0], [33, 1, 33, 2, 0, 0, 0, 0], [34, 1, 34, 2, 0, 0, 0, 0], [33, 3, 33, 4, 0, 0, 0, 0], [32, 3, 32, 4, 0, 0, 0, 0], [33, 5, 33, 6, 0, 0, 0, 0], [34, 5, 34, 6, 0, 0, 0, 0], [33, 7, 33, 8, 0, 0, 0, 0], [32, 7, 32, 8, 0, 0, 0, 0], [33, 9, 33, 10, 0, 0, 0, 0], [34, 9, 34, 10, 0, 0, 0, 0], [35, 1, 35, 2, 0, 0, 0, 0], [36, 1, 36, 2, 0, 0, 0, 0], [35, 3, 35, 4, 0, 0, 0, 0], [34, 3, 34, 4, 0, 0, 0, 0], [35, 5, 35, 6, 0, 0, 0, 0], [36, 5, 36, 6, 0, 0, 0, 0], [35, 7, 35, 8, 0, 0, 0, 0], [34, 7, 34, 8, 0, 0, 0, 0], [35, 9, 35, 10, 0, 0, 0, 0], [36, 9, 36, 10, 0, 0, 0, 0], [37, 1, 37, 2, 0, 0, 0, 0], [38, 1, 38, 2, 0, 0, 0, 0], [37, 3, 37, 4, 0, 0, 0, 0], [36, 3, 36, 4, 0, 0, 0, 0], [37, 5, 37, 6, 0, 0, 0, 0], [38, 5, 38, 6, 0, 0, 0, 0], [37, 7, 37, 8, 0, 0, 0, 0], [36, 7, 36, 8, 0, 0, 0, 0], [37, 9, 37, 10, 0, 0, 0, 0], [38, 9, 38, 10, 0, 0, 0, 0], [39, 3, 39, 4, 0, 0, 0, 0], [38, 3, 38, 4, 0, 0, 0, 0], [39, 7, 39, 8, 0, 0, 0, 0], [38, 7, 38, 8, 0, 0, 0, 0], [41, 1, 41, 2, 0, 0, 0, 0], [40, 1, 40, 2, 0, 0, 0, 0], [41, 3, 41, 4, 0, 0, 0, 0], [42, 3, 42, 4, 0, 0, 0, 0], [41, 5, 41, 6, 0, 0, 0, 0], [40, 5, 40, 6, 0, 0, 0, 0], [41, 7, 41, 8, 0, 0, 0, 0], [42, 7, 42, 8, 0, 0, 0, 0], [41, 9, 41, 10, 0, 0, 0, 0], [40, 9, 40, 10, 0, 0, 0, 0], [43, 1, 43, 2, 0, 0, 0, 0], [42, 1, 42, 2, 0, 0, 0, 0], [43, 3, 43, 4, 0, 0, 0, 0], [44, 3, 44, 4, 0, 0, 0, 0], [43, 5, 43, 6, 0, 0, 0, 0], [42, 5, 42, 6, 0, 0, 0, 0], [43, 7, 43, 8, 0, 0, 0, 0], [44, 7, 44, 8, 0, 0, 0, 0], [43, 9, 43, 10, 0, 0, 0, 0], [42, 9, 42, 10, 0, 0, 0, 0], [45, 1, 45, 2, 0, 0, 0, 0], [44, 1, 44, 2, 0, 0, 0, 0], [45, 3, 45, 4, 0, 0, 0, 0], [46, 3, 46, 4, 0, 0, 0, 0], [45, 5, 45, 6, 0, 0, 0, 0], [44, 5, 44, 6, 0, 0, 0, 0], [45, 7, 45, 8, 0, 0, 0, 0], [46, 7, 46, 8, 0, 0, 0, 0], [45, 9, 45, 10, 0, 0, 0, 0], [44, 9, 44, 10, 0, 0, 0, 0], [47, 1, 47, 2, 0, 0, 0, 0], [46, 1, 46, 2, 0, 0, 0, 0], [47, 3, 47, 4, 0, 0, 0, 0], [48, 3, 48, 4, 0, 0, 0, 0], [47, 5, 47, 6, 0, 0, 0, 0], [46, 5, 46, 6, 0, 0, 0, 0], [47, 7, 47, 8, 0, 0, 0, 0], [48, 7, 48, 8, 0, 0, 0, 0], [47, 9, 47, 10, 0, 0, 0, 0], [46, 9, 46, 10, 0, 0, 0, 0], [49, 1, 49, 2, 0, 0, 0, 0], [48, 1, 48, 2, 0, 0, 0, 0], [49, 5, 49, 6, 0, 0, 0, 0], [48, 5, 48, 6, 0, 0, 0, 0], [49, 9, 49, 10, 0, 0, 0, 0], [48, 9, 48, 10, 0, 0, 0, 0], [51, 1, 51, 2, 0, 0, 0, 0], [52, 1, 52, 2, 0, 0, 0, 0], [51, 3, 51, 4, 0, 0, 0, 0], [50, 3, 50, 4, 0, 0, 0, 0], [51, 5, 51, 6, 0, 0, 0, 0], [52, 5, 52, 6, 0, 0, 0, 0], [51, 7, 51, 8, 0, 0, 0, 0], [50, 7, 50, 8, 0, 0, 0, 0], [51, 9, 51, 10, 0, 0, 0, 0], [52, 9, 52, 10, 0, 0, 0, 0], [53, 1, 53, 2, 0, 0, 0, 0], [54, 1, 54, 2, 0, 0, 0, 0], [53, 3, 53, 4, 0, 0, 0, 0], [52, 3, 52, 4, 0, 0, 0, 0], [53, 5, 53, 6, 0, 0, 0, 0], [54, 5, 54, 6, 0, 0, 0, 0], [53, 7, 53, 8, 0, 0, 0, 0], [52, 7, 52, 8, 0, 0, 0, 0], [53, 9, 53, 10, 0, 0, 0, 0], [54, 9, 54, 10, 0, 0, 0, 0], [55, 1, 55, 2, 0, 0, 0, 0], [56, 1, 56, 2, 0, 0, 0, 0], [55, 3, 55, 4, 0, 0, 0, 0], [54, 3, 54, 4, 0, 0, 0, 0], [55, 5, 55, 6, 0, 0, 0, 0], [56, 5, 56, 6, 0, 0, 0, 0], [55, 7, 55, 8, 0, 0, 0, 0], [54, 7, 54, 8, 0, 0, 0, 0], [55, 9, 55, 10, 0, 0, 0, 0], [56, 9, 56, 10, 0, 0, 0, 0], [57, 1, 57, 2, 0, 0, 0, 0], [58, 1, 58, 2, 0, 0, 0, 0], [57, 3, 57, 4, 0, 0, 0, 0], [56, 3, 56, 4, 0, 0, 0, 0], [57, 5, 57, 6, 0, 0, 0, 0], [58, 5, 58, 6, 0, 0, 0, 0], [57, 7, 57, 8, 0, 0, 0, 0], [56, 7, 56, 8, 0, 0, 0, 0], [57, 9, 57, 10, 0, 0, 0, 0], [58, 9, 58, 10, 0, 0, 0, 0], [59, 3, 59, 4, 0, 0, 0, 0], [58, 3, 58, 4, 0, 0, 0, 0], [59, 7, 59, 8, 0, 0, 0, 0], [58, 7, 58, 8, 0, 0, 0, 0], [61, 1, 61, 2, 0, 0, 0, 0], [60, 1, 60, 2, 0, 0, 0, 0], [61, 3, 61, 4, 0, 0, 0, 0], [62, 3, 62, 4, 0, 0, 0, 0], [61, 5, 61, 6, 0, 0, 0, 0], [60, 5, 60, 6, 0, 0, 0, 0], [61, 7, 61, 8, 0, 0, 0, 0], [62, 7, 62, 8, 0, 0, 0, 0], [61, 9, 61, 10, 0, 0, 0, 0], [60, 9, 60, 10, 0, 0, 0, 0], [63, 1, 63, 2, 0, 0, 0, 0], [62, 1, 62, 2, 0, 0, 0, 0], [63, 3, 63, 4, 0, 0, 0, 0], [64, 3, 64, 4, 0, 0, 0, 0], [63, 5, 63, 6, 0, 0, 0, 0], [62, 5, 62, 6, 0, 0, 0, 0], [63, 7, 63, 8, 0, 0, 0, 0], [64, 7, 64, 8, 0, 0, 0, 0], [63, 9, 63, 10, 0, 0, 0, 0], [62, 9, 62, 10, 0, 0, 0, 0], [65, 1, 65, 2, 0, 0, 0, 0], [64, 1, 64, 2, 0, 0, 0, 0], [65, 3, 65, 4, 0, 0, 0, 0], [66, 3, 66, 4, 0, 0, 0, 0], [65, 5, 65, 6, 0, 0, 0, 0], [64, 5, 64, 6, 0, 0, 0, 0], [65, 7, 65, 8, 0, 0, 0, 0], [66, 7, 66, 8, 0, 0, 0, 0], [65, 9, 65, 10, 0, 0, 0, 0], [64, 9, 64, 10, 0, 0, 0, 0], [67, 1, 67, 2, 0, 0, 0, 0], [66, 1, 66, 2, 0, 0, 0, 0], [67, 3, 67, 4, 0, 0, 0, 0], [68, 3, 68, 4, 0, 0, 0, 0], [67, 5, 67, 6, 0, 0, 0, 0], [66, 5, 66, 6, 0, 0, 0, 0], [67, 7, 67, 8, 0, 0, 0, 0], [68, 7, 68, 8, 0, 0, 0, 0], [67, 9, 67, 10, 0, 0, 0, 0], [66, 9, 66, 10, 0, 0, 0, 0], [69, 1, 69, 2, 0, 0, 0, 0], [68, 1, 68, 2, 0, 0, 0, 0], [69, 5, 69, 6, 0, 0, 0, 0], [68, 5, 68, 6, 0, 0, 0, 0], [69, 9, 69, 10, 0, 0, 0, 0], [68, 9, 68, 10, 0, 0, 0, 0], [71, 1, 71, 2, 0, 0, 0, 0], [72, 1, 72, 2, 0, 0, 0, 0], [71, 3, 71, 4, 0, 0, 0, 0], [70, 3, 70, 4, 0, 0, 0, 0], [71, 5, 71, 6, 0, 0, 0, 0], [72, 5, 72, 6, 0, 0, 0, 0], [71, 7, 71, 8, 0, 0, 0, 0], [70, 7, 70, 8, 0, 0, 0, 0], [71, 9, 71, 10, 0, 0, 0, 0], [72, 9, 72, 10, 0, 0, 0, 0], [73, 1, 73, 2, 0, 0, 0, 0], [74, 1, 74, 2, 0, 0, 0, 0], [73, 3, 73, 4, 0, 0, 0, 0], [72, 3, 72, 4, 0, 0, 0, 0], [73, 5, 73, 6, 0, 0, 0, 0], [74, 5, 74, 6, 0, 0, 0, 0], [73, 7, 73, 8, 0, 0, 0, 0], [72, 7, 72, 8, 0, 0, 0, 0], [73, 9, 73, 10, 0, 0, 0, 0], [74, 9, 74, 10, 0, 0, 0, 0], [75, 1, 75, 2, 0, 0, 0, 0], [76, 1, 76, 2, 0, 0, 0, 0], [75, 3, 75, 4, 0, 0, 0, 0], [74, 3, 74, 4, 0, 0, 0, 0], [75, 5, 75, 6, 0, 0, 0, 0], [76, 5, 76, 6, 0, 0, 0, 0], [75, 7, 75, 8, 0, 0, 0, 0], [74, 7, 74, 8, 0, 0, 0, 0], [75, 9, 75, 10, 0, 0, 0, 0], [76, 9, 76, 10, 0, 0, 0, 0], [77, 1, 77, 2, 0, 0, 0, 0], TABLE 32-continued

[78, 1, 78, 2, 0, 0, 0, 0], [77, 3, 77, 4, 0, 0, 0, 0], [76, 3, 76, 4, 0, 0, 0, 0], [77, 5, 77, 6, 0, 0, 0, 0], [78, 5, 78, 6, 0, 0, 0, 0], [77, 7, 77, 8, 0, 0, 0, 0], [76, 7, 76, 8, 0, 0, 0, 0], [77, 9, 77, 10, 0, 0, 0, 0], [78, 9, 78, 10, 0, 0, 0, 0], [79, 3, 79, 4, 0, 0, 0, 0], [78, 3, 78, 4, 0, 0, 0, 0], [79, 7, 79, 8, 0, 0, 0, 0], [78, 7, 78, 8, 0, 0, 0, 0], [81, 1, 81, 2, 0, 0, 0, 0], [80, 1, 80, 2, 0, 0, 0, 0], [81, 3, 81, 4, 0, 0, 0, 0], [82, 3, 82, 4, 0, 0, 0, 0], [81, 5, 81, 6, 0, 0, 0, 0], [80, 5, 80, 6, 0, 0, 0, 0], [81, 7, 81, 8, 0, 0, 0, 0], [82, 7, 82, 8, 0, 0, 0, 0], [81, 9, 81, 10, 0, 0, 0, 0], [80, 9, 80, 10, 0, 0, 0, 0], [83, 1, 83, 2, 0, 0, 0, 0], [82, 1, 82, 2, 0, 0, 0, 0], [83, 3, 83, 4, 0, 0, 0, 0], [84, 3, 84, 4, 0, 0, 0, 0], [83, 5, 83, 6, 0, 0, 0, 0], [82, 5, 82, 6, 0, 0, 0, 0], [83, 7, 83, 8, 0, 0, 0, 0], [84, 7, 84, 8, 0, 0, 0, 0], [83, 9, 83, 10, 0, 0, 0, 0], [82, 9, 82, 10, 0, 0, 0, 0], [85, 1, 85, 2, 0, 0, 0, 0], [84, 1, 84, 2, 0, 0, 0, 0], [85, 3, 85, 4, 0, 0, 0, 0], [86, 3, 86, 4, 0, 0, 0, 0], [85, 5, 85, 6, 0, 0, 0, 0], [84, 5, 84, 6, 0, 0, 0, 0], [85, 7, 85, 8, 0, 0, 0, 0], [86, 7, 86, 8, 0, 0, 0, 0], [85, 9, 85, 10, 0, 0, 0, 0], [84, 9, 84, 10, 0, 0, 0, 0], [87, 1, 87, 2, 0, 0, 0, 0], [86, 1, 86, 2, 0, 0, 0, 0], [87, 3, 87, 4, 0, 0, 0, 0], [88, 3, 88, 4, 0, 0, 0, 0], [87, 5, 87, 6, 0, 0, 0, 0], [86, 5, 86, 6, 0, 0, 0, 0], [87, 7, 87, 8, 0, 0, 0, 0], [88, 7, 88, 8, 0, 0, 0, 0], [87, 9, 87, 10, 0, 0, 0, 0], [86, 9, 86, 10, 0, 0, 0, 0], [89, 1, 89, 2, 0, 0, 0, 0], [88, 1, 88, 2, 0, 0, 0, 0], [89, 5, 89, 6, 0, 0, 0, 0], [88, 5, 88, 6, 0, 0, 0, 0], [89, 9, 89, 10, 0, 0, 0, 0], [88, 9, 88, 10, 0, 0, 0, 0], [91, 1, 91, 2, 0, 0, 0, 0], [92, 1, 92, 2, 0, 0, 0, 0], [91, 3, 91, 4, 0, 0, 0, 0], [90, 3, 90, 4, 0, 0, 0, 0], [91, 5, 91, 6, 0, 0, 0, 0], [92, 5, 92, 6, 0, 0, 0, 0], [91, 7, 91, 8, 0, 0, 0, 0], [90, 7, 90, 8, 0, 0, 0, 0], [91, 9, 91, 10, 0, 0, 0, 0], [92, 9, 92, 10, 0, 0, 0, 0], [93, 1, 93, 2, 0, 0, 0, 0], [94, 1, 94, 2, 0, 0, 0, 0], [93, 3, 93, 4, 0, 0, 0, 0], [92, 3, 92, 4, 0, 0, 0, 0], [93, 5, 93, 6, 0, 0, 0, 0], [94, 5, 94, 6, 0, 0, 0, 0], [93, 7, 93, 8, 0, 0, 0, 0], [92, 7, 92, 8, 0, 0, 0, 0], [93, 9, 93, 10, 0, 0, 0, 0], [94, 9, 94, 10, 0, 0, 0, 0], [95, 1, 95, 2, 0, 0, 0, 0], [96, 1, 96, 2, 0, 0, 0, 0], [95, 3, 95, 4, 0, 0, 0, 0], [94, 3, 94, 4, 0, 0, 0, 0], [95, 5, 95, 6, 0, 0, 0, 0], [96, 5, 96, 6, 0, 0, 0, 0], [95, 7, 95, 8, 0, 0, 0, 0], [94, 7, 94, 8, 0, 0, 0, 0], [95, 9, 95, 10, 0, 0, 0, 0], [96, 9, 96, 10, 0, 0, 0, 0], [97, 1, 97, 2, 0, 0, 0, 0], [98, 1, 98, 2, 0, 0, 0, 0], [97, 3, 97, 4, 0, 0, 0, 0], [96, 3, 96, 4, 0, 0, 0, 0], [97, 5, 97, 6, 0, 0, 0, 0], [98, 5, 98, 6, 0, 0, 0, 0], [97, 7, 97, 8, 0, 0, 0, 0], [96, 7, 96, 8, 0, 0, 0, 0], [97, 9, 97, 10, 0, 0, 0, 0], [98, 9, 98, 10, 0, 0, 0, 0], [99, 3, 99, 4, 0, 0, 0, 0], [98, 3, 98, 4, 0, 0, 0, 0], [99, 7, 99, 8, 0, 0, 0, 0], [98, 7, 98, 8, 0, 0, 0, 0], [0, 2, 0, 3, 0, 0, 0, 0], [19, 2, 19, 3, 0, 0, 0, 0], [0, 6, 0, 7, 0, 0, 0, 0], [19, 6, 19, 7, 0, 0, 0, 0], [2, 2, 2, 3, 0, 0, 0, 0], [17, 2, 17, 3, 0, 0, 0, 0], [2, 6, 2, 7, 0, 0, 0, 0], [17, 6, 17, 7, 0, 0, 0, 0], [4, 2, 4, 3, 0, 0, 0, 0], [15, 2, 15, 3, 0, 0, 0, 0], [4, 6, 4, 7, 0, 0, 0, 0], [15, 6, 15, 7, 0, 0, 0, 0], [6, 2, 6, 3, 0, 0, 0, 0], [13, 2, 13, 3, 0, 0, 0, 0], [6, 6, 6, 7, 0, 0, 0, 0], [13, 6, 13, 7, 0, 0, 0, 0], [8, 2, 8, 3, 0, 0, 0, 0], [11, 2, 11, 3, 0, 0, 0, 0], [8, 6, 8, 7, 0, 0, 0, 0], [11, 6, 11, 7, 0, 0, 0, 0], [10, 2, 10, 3, 0, 0, 0, 0], [29, 2, 29, 3, 0, 0, 0, 0], [10, 4, 10, 5, 0, 0, 0, 0], [9, 4, 9, 5, 0, 0, 0, 0], [10, 6, 10, 7, 0, 0, 0, 0], [29, 6, 29, 7, 0, 0, 0, 0], [10, 8, 10, 9, 0, 0, 0, 0], [9, 8, 9, 9, 0, 0, 0, 0], [12, 2, 12, 3, 0, 0, 0, 0], [27, 2, 27, 3, 0, 0, 0, 0], [12, 4, 12, 5, 0, 0, 0, 0], [7, 4, 7, 5, 0, 0, 0, 0], [12, 6, 12, 7, 0, 0, 0, 0], [27, 6, 27, 7, 0, 0, 0, 0], [12, 8, 12, 9, 0, 0, 0, 0], [7, 8, 7, 9, 0, 0, 0, 0], [14, 2, 14, 3, 0, 0, 0, 0], [25, 2, 25, 3, 0, 0, 0, 0], [14, 4, 14, 5, 0, 0, 0, 0], [5, 4, 5, 5, 0, 0, 0, 0], [14, 6, 14, 7, 0, 0, 0, 0], [25, 6, 25, 7, 0, 0, 0, 0], [14, 8, 14, 9, 0, 0, 0, 0], [5, 8, 5, 9, 0, 0, 0, 0], [16, 2, 16, 3, 0, 0, 0, 0], [23, 2, 23, 3, 0, 0, 0, 0], [16, 4, 16, 5, 0, 0, 0, 0], [3, 4, 3, 5, 0, 0, 0, 0], [16, 6, 16, 7, 0, 0, 0, 0], [23, 6, 23, 7, 0, 0, 0, 0], [16, 8, 16, 9, 0, 0, 0, 0], [3, 8, 3, 9, 0, 0, 0, 0], [18, 2, 18, 3, 0, 0, 0, 0], [21, 2, 21, 3, 0, 0, 0, 0], [18, 4, 18, 5, 0, 0, 0, 0], [1, 4, 1, 5, 0, 0, 0, 0], [18, 6, 18, 7, 0, 0, 0, 0], [21, 6, 21, 7, 0, 0, 0, 0], [18, 8, 18, 9, 0, 0, 0, 0], [1, 8, 1, 9, 0, 0, 0, 0], [20, 2, 20, 3, 0, 0, 0, 0], [39, 2, 39, 3, 0, 0, 0, 0], [20, 4, 20, 5, 0, 0, 0, 0], [19, 4, 19, 5, 0, 0, 0, 0], [20, 6, 20, 7, 0, 0, 0, 0], [39, 6, 39, 7, 0, 0, 0, 0], [20, 8, 20, 9, 0, 0, 0, 0], [19, 8, 19, 9, 0, 0, 0, 0], [22, 2, 22, 3, 0, 0, 0, 0], [37, 2, 37, 3, 0, 0, 0, 0], [22, 4, 22, 5, 0, 0, 0, 0], [17, 4, 17, 5, 0, 0, 0, 0], [22, 6, 22, 7, 0, 0, 0, 0], [37, 6, 37, 7, 0, 0, 0, 0], [22, 8, 22, 9, 0, 0, 0, 0], [17, 8, 17, 9, 0, 0, 0, 0], [24, 2, 24, 3, 0, 0, 0, 0], [35, 2, 35, 3, 0, 0, 0, 0], [24, 4, 24, 5, 0, 0, 0, 0], [15, 4, 15, 5, 0, 0, 0, 0], [24, 6, 24, 7, 0, 0, 0, 0], [35, 6, 35, 7, 0, 0, 0, 0], [24, 8, 24, 9, 0, 0, 0, 0], [15, 8, 15, 9, 0, 0, 0, 0], [26, 2, 26, 3, 0, 0, 0, 0], [33, 2, 33, 3, 0, 0, 0, 0], [26, 4, 26, 5, 0, 0, 0, 0], [13, 4, 13, 5, 0, 0, 0, 0], [26, 6, 26, 7, 0, 0, 0, 0], [33, 6, 33, 7, 0, 0, 0, 0], [26, 8, 26, 9, 0, 0, 0, 0], [13, 8, 13, 9, 0, 0, 0, 0], [28, 2, 28, 3, 0, 0, 0, 0], [31, 2, 31, 3, 0, 0, 0, 0], [28, 4, 28, 5, 0, 0, 0, 0], [11, 4, 11, 5, 0, 0, 0, 0], [28, 6, 28, 7, 0, 0, 0, 0], [31, 6, 31, 7, 0, 0, 0, 0], [28, 8, 28, 9, 0, 0, 0, 0], [11, 8, 11, 9, 0, 0, 0, 0], [30, 2, 30, 3, 0, 0, 0, 0], [49, 2, 49, 3, 0, 0, 0, 0], [30, 4, 30, 5, 0, 0, 0, 0], [29, 4, 29, 5, 0, 0, 0, 0], [30, 6, 30, 7, 0, 0, 0, 0], [49, 6, 49, 7, 0, 0, 0, 0], [30, 8, 30, 9, 0, 0, 0, 0], [29, 8, 29, 9, 0, 0, 0, 0], [32, 2, 32, 3, 0, 0, 0, 0], [47, 2, 47, 3, 0, 0, 0, 0], [32, 4, 32, 5, 0, 0, 0, 0], [27, 4, 27, 5, 0, 0, 0, 0], [32, 6, 32, 7, 0, 0, 0, 0], [47, 6, 47, 7, 0, 0, 0, 0], [32, 8, 32, 9, 0, 0, 0, 0], [27, 8, 27, 9, 0, 0, 0, 0], [34, 2, 34, 3, 0, 0, 0, 0], [45, 2, 45, 3, 0, 0, 0, 0], [34, 4, 34, 5, 0, 0, 0, 0], [25, 4, 25, 5, 0, 0, 0, 0], [34, 6, 34, 7, 0, 0, 0, 0], [45, 6, 45, 7, 0, 0, 0, 0], [34, 8, 34, 9, 0, 0, 0, 0], [25, 8, 25, 9, 0, 0, 0, 0], [36, 2, 36, 3, 0, 0, 0, 0], [43, 2, 43, 3, 0, 0, 0, 0], [36, 4, 36, 5, 0, 0, 0, 0], [23, 4, 23, 5, 0, 0, 0, 0], [36, 6, 36, 7, 0, 0, 0, 0], [43, 6, 43, 7, 0, 0, 0, 0], [36, 8, 36, 9, 0, 0, 0, 0], [23, 8, 23, 9, 0, 0, 0, 0], [38, 2, 38, 3, 0, 0, 0, 0], [41, 2, 41, 3, 0, 0, 0, 0], [38, 4, 38, 5, 0, 0, 0, 0], [21, 4, 21, 5, 0, 0, 0, 0], [38, 6, 38, 7, 0, 0, 0, 0], [41, 6, 41, 7, 0, 0, 0, 0], [38, 8, 38, 9, 0, 0, 0, 0], [21, 8, 21, 9, 0, 0, 0, 0], [40, 2, 40, 3, 0, 0, 0, 0], [59, 2, 59, 3, 0, 0, 0, 0], [40, 4, 40, 5, 0, 0, 0, 0], [39, 4, 39, 5, 0, 0, 0, 0], [40, 6, 40, 7, 0, 0, 0, 0], [59, 6, 59, 7, 0, 0, 0, 0], [40, 8, 40, 9, 0, 0, 0, 0], [39, 8, 39, 9, 0, 0, 0, 0], [42, 2, 42, 3, 0, 0, 0, 0], [57, 2, 57, 3, 0, 0, 0, 0], [42, 4, 42, 5, 0, 0, 0, 0], [37, 4, 37, 5, 0, 0, 0, 0], [42, 6, 42, 7, 0, 0, 0, 0], [57, 6, 57, 7, 0, 0, 0, 0], [42, 8, 42, 9, 0, 0, 0, 0], [37, 8, 37, 9, 0, 0, 0, 0], [44, 2, 44, 3, 0, 0, 0, 0], [55, 2, 55, 3, 0, 0, 0, 0], [44, 4, 44, 5, 0, 0, 0, 0], [35, 4, 35, 5, 0, 0, 0, 0], [44, 6, 44, 7, 0, 0, 0, 0], [55, 6, 55, 7, 0, 0, 0, 0], [44, 8, 44, 9, 0, 0, 0, 0], [35, 8, 35, 9, 0, 0, 0, 0], [46, 2, 46, 3, 0, 0, 0, 0], [53, 2, 53, 3, 0, 0, 0, 0], [46, 4, 46, 5, 0, 0, 0, 0], [33, 4, 33, 5, 0, 0, 0, 0], [46, 6, 46, 7, 0, 0, 0, 0], [53, 6, 53, 7, 0, 0, 0, 0], [46, 8, 46, 9, 0, 0, 0, 0], [33, 8, 33, 9, 0, 0, 0, 0], [48, 2, 48, 3, 0, 0, 0, 0], [51, 2, 51, 3, 0, 0, 0, 0], [48, 4, 48, 5, 0, 0, 0, 0], [31, 4, 31, 5, 0, 0, 0, 0], [48, 6, 48, 7, 0, 0, 0, 0], [51, 6, 51, 7, 0, 0, 0, 0], [48, 8, 48, 9, 0, 0, 0, 0], [31, 8, 31, 9, 0, 0, 0, 0], [50, 2, 50, 3, 0, 0, 0, 0], [69, 2, 69, 3, 0, 0, 0, 0], [50, 4, 50, 5, 0, 0, 0, 0], [49, 4, 49, 5, 0, 0, 0, 0], [50, 6, 50, 7, 0, 0, 0, 0], [69, 6, 69, 7, 0, 0, 0, 0], [50, 8, 50, 9, 0, 0, 0, 0], [49, 8, 49, 9, 0, 0, 0, 0], [52, 2, 52, 3, 0, 0, 0, 0], [67, 2, 67, 3, 0, 0, 0, 0], [52, 4, 52, 5, 0, 0, 0, 0], [47, 4, 47, 5, 0, 0, 0, 0], [52, 6, 52, 7, 0, 0, 0, 0], [67, 6, 67, 7, 0, 0, 0, 0], [52, 8, 52, 9, 0, 0, 0, 0], [47, 8, 47, 9, 0, 0, 0, 0], [54, 2, 54, 3, 0, 0, 0, 0], [65, 2, 65, 3, 0, 0, 0, 0], [54, 4, 54, 5, 0, 0, 0, 0], [45, 4, 45, 5, 0, 0, 0, 0], [54, 6, 54, 7, 0, 0, 0, 0], [65, 6, 65, 7, 0, 0, 0, 0], [54, 8, 54, 9, 0, 0, 0, 0], [45, 8, 45, 9, 0, 0, 0, 0], [56, 2, 56, 3, 0, 0, 0, 0], [63, 2, 63, 3, 0, 0, 0, 0], [56, 4, 56, 5, 0, 0, 0, 0], [43, 4, 43, 5, 0, 0, 0, 0], [56, 6, 56, 7, 0, 0, 0, 0], [63, 6, 63, 7, 0, 0, 0, 0], [56, 8, 56, 9, 0, 0, 0, 0], [43, 8, 43, 9, 0, 0, 0, 0], [58, 2, 58, 3, 0, 0, 0, 0], [61, 2, 61, 3, 0, 0, 0, 0], [58, 4, 58, 5, 0, 0, 0, 0], [41, 4, 41, 5, 0, 0, 0, 0], [58, 6, 58, 7, 0, 0, 0, 0], [61, 6, 61, 7, 0, 0, 0, 0], [58, 8, 58, 9, 0, 0, 0, 0], [41, 8, 41, 9, 0, 0, 0, 0], [60, 2, 60, 3, 0, 0, 0, 0], [79, 2, 79, 3, 0, 0, 0, 0], [60, 4, 60, 5, 0, 0, 0, 0], [59, 4, 59, 5, 0, 0, 0, 0], [60, 6, 60, 7, 0, 0, 0, 0], [79, 6, 79, 7, 0, 0, 0, 0], [60, 8, 60, 9, 0, 0, 0, 0], [59, 8, 59, 9, 0, 0, 0, 0], [62, 2, 62, 3, 0, 0, 0, 0], [77, 2, 77, 3, 0, 0, 0, 0], [62, 4, 62, 5, 0, 0, 0, 0], [57, 4, 57, 5, 0, 0, 0, 0], [62, 6, 62, 7, 0, 0, 0, 0], [77, 6, 77, 7, 0, 0, 0, 0], [62, 8, 62, 9, 0, 0, 0, 0], [57, 8, 57, 9, 0, 0, 0, 0], [64, 2, 64, 3, 0, 0, 0, 0], [75, 2, 75, 3, 0, 0, 0, 0], [64, 4, 64, 5, 0, 0, 0, 0], [55, 4, 55, 5, 0, 0, 0, 0], [64, 6, 64, 7, 0, 0, 0, 0], [75, 6, 75, 7, 0, 0, 0, 0], [64, 8, 64, 9, 0, 0, 0, 0], [55, 8, 55, 9, 0, 0, 0, 0], [66, 2, 66, 3, 0, 0, 0, 0], [73, 2, 73, 3, 0, 0, 0, 0], [66, 4, 66, 5, 0, 0, 0, 0], [53, 4, 53, 5, 0, 0, 0, 0], [66, 6, 66, 7, 0, 0, 0, 0], [73, 6, 73, 7, 0, 0, 0, 0], [66, 8, 66, 9, 0, 0, 0, 0], [53, 8, 53, 9, 0, 0, 0, 0], [68, 2, 68, 3, 0, 0, 0, 0], [71, 2, 71, 3, 0, 0, 0, 0], [68, 4, 68, 5, 0, 0, 0, 0], [51, 4, 51, 5, 0, 0, 0, 0], [68, 6, 68, 7, 0, 0, 0, 0], [71, 6, 71, 7, 0, 0, 0, 0], [68, 8, 68, 9, 0, 0, 0, 0], [51, 8, 51, 9, 0, 0, 0, 0], [70, 2, 70, 3, 0, 0, 0, 0], [89, 2, 89, 3, 0, 0, 0, 0], [70, 4, 70, 5, 0, 0, 0, 0], [69, 4, 69, 5, 0, 0, 0, 0], [70, 6, 70, 7, 0, 0, 0, 0], [89, 6, 89, 7, 0, 0, 0, 0], [70, 8, 70, 9, 0, 0, 0, 0], [69, 8, 69, 9, 0, 0, 0, 0], [72, 2, 72, 3, 0, 0, 0, 0], [87, 2, 87, 3, 0, 0, 0, 0], [72, 4, 72, 5, 0, 0, 0, 0], [67, 4, 67, 5, 0, 0, 0, 0], [72, 6, 72, 7, 0, 0, 0, 0], [87, 6, 87, 7, 0, 0, 0, 0], [72, 8, 72, 9, 0, 0, 0, 0], [67, 8, 67, 9, 0, 0, 0, 0], [74, 2, 74, 3, 0, 0, 0, 0], [85, 2, 85, 3, 0, 0, 0, 0], [74, 4, 74, 5, 0, 0, 0, 0], [65, 4, 65, 5, 0, 0, 0, 0], [74, 6, 74, 7, 0, 0, 0, 0], [85, 6, 85, 7, 0, 0, 0, 0], [74, 8, 74, 9, 0, 0, 0, 0], [65, 8, 65, 9, 0, 0, 0, 0], [76, 2, 76, 3, 0, 0, 0, 0], [83, 2, 83, 3, 0, 0, 0, 0], [76, 4, 76, 5, 0, 0, 0, 0], [63, 4, 63, 5, 0, 0, 0, 0], [76, 6, 76, 7, 0, 0, 0, 0], [83, 6, 83, 7, 0, 0, 0, 0], [76, 8, 76, 9, 0, 0, 0, 0], [63, 8, 63, 9, 0, 0, 0, 0], [78, 2, 78, 3, 0, 0, 0, 0], [81, 2, 81, 3, 0, 0, 0, 0], [78, 4, 78, 5, 0, 0, 0, 0], [61, 4, 61, 5, 0, 0, 0, 0], [78, 6, 78, 7, 0, 0, 0, 0], [81, 6, 81, 7, 0, 0, 0, 0], [78, 8, 78, 9, 0, 0, 0, 0], [61, 8, 61, 9, 0, 0, 0, 0], [80, 2, 80, 3, 0, 0, 0, 0], [99, 2, 99, 3, 0, 0, 0, 0], [80, 4, 80, 5, 0, 0, 0, 0], [79, 4, 79, 5, 0, 0, 0, 0], [80, 6, 80, 7, 0, 0, 0, 0], [99, 6, 99, 7, 0, 0, 0, 0], [80, 8, 80, 9, 0, 0, 0, 0], [79, 8, 79, 9, 0, 0, 0, 0], [82, 2, 82, 3, 0, 0, 0, 0], [97, 2, 97, 3, 0, 0, 0, 0], [82, 4, 82, 5, 0, 0, 0, 0], [77, 4, 77, 5, 0, 0, 0, 0], [82, 6, 82, 7, 0, 0, 0, 0], [97, 6, 97, 7, 0, 0, 0, 0], [82, 8, 82, 9, 0, 0, 0, 0], [77, 8, 77, 9, 0, 0, 0, 0], [84, 2, 84, 3, 0, 0, 0, 0], [95, 2, 95, 3, 0, 0, 0, 0], [84, 4, 84, 5, 0, 0, 0, 0], [75, 4, 75, 5, 0, 0, 0, 0], [84, 6, 84, 7, 0, 0, 0, 0], [95, 6, 95, 7, 0, 0, 0, 0], [84, 8, 84, 9, 0, 0, 0, 0], [75, 8, 75, 9, 0, 0, 0, 0], [86, 2, 86, 3, 0, 0, 0, 0], [93, 2, 93, 3, 0, 0, 0, 0], [86, 4, 86, 5, 0, 0, 0, 0], [73, 4, 73, 5, 0, 0, 0, 0], [86, 6, 86, 7, 0, 0, 0, 0], [93, 6, 93, 7, 0, 0, 0, 0], [86, 8, 86, 9, 0, 0, 0, 0], [73, 8, 73, 9, 0, 0, 0, 0], [88, 2, 88, 3, 0, 0, 0, 0], [91, 2, 91, 3, 0, 0, 0, 0], [88, 4, 88, 5, 0, 0, 0, 0], [71, 4, 71, 5, 0, 0, 0, 0], [88, 6, 88, 7, 0, 0, 0, 0], [91, 6, 91, 7, 0, 0, 0, 0], [88, 8, 88, 9, 0, 0, 0, 0], [71, 8, 71, 9, 0, 0, 0, 0],

TABLE 32-continued

[90, 4, 90, 5, 0, 0, 0, 0], [89, 4, 89, 5, 0, 0, 0, 0], [90, 8, 90, 9, 0, 0, 0, 0], [89, 8, 89, 9, 0, 0, 0, 0], [92, 4, 92, 5, 0, 0, 0, 0], [87, 4, 87, 5, 0, 0, 0, 0], [92, 8, 92, 9, 0, 0, 0, 0], [87, 8, 87, 9, 0, 0, 0, 0], [94, 4, 94, 5, 0, 0, 0, 0], [85, 4, 85, 5, 0, 0, 0, 0], [94, 8, 94, 9, 0, 0, 0, 0], [85, 8, 85, 9, 0, 0, 0, 0], [96, 4, 96, 5, 0, 0, 0, 0], [83, 4, 83, 5, 0, 0, 0, 0], [96, 8, 96, 9, 0, 0, 0, 0], [83, 8, 83, 9, 0, 0, 0, 0], [98, 4, 98, 5, 0, 0, 0, 0], [81, 4, 81, 5, 0, 0, 0, 0], [98, 8, 98, 9, 0, 0, 0, 0], [81, 8, 81, 9, 0, 0, 0, 0], [0, 3, 0, 4, 0, 0, 0, 0], [0, 7, 0, 8, 0, 0, 0, 0], [9, 3, 9, 4, 0, 0, 0, 0], [9, 7, 9, 8, 0, 0, 0, 0], [10, 1, 10, 2, 0, 0, 0, 0], [10, 5, 10, 6, 0, 0, 0, 0], [10, 9, 10, 10, 0, 0, 0, 0], [19, 1, 19, 2, 0, 0, 0, 0], [19, 5, 19, 6, 0, 0, 0, 0], [19, 9, 19, 10, 0, 0, 0, 0], [20, 3, 20, 4, 0, 0, 0, 0], [20, 7, 20, 8, 0, 0, 0, 0], [29, 3, 29, 4, 0, 0, 0, 0], [29, 7, 29, 8, 0, 0, 0, 0], [30, 1, 30, 2, 0, 0, 0, 0], [30, 5, 30, 6, 0, 0, 0, 0], [30, 9, 30, 10, 0, 0, 0, 0], [39, 1, 39, 2, 0, 0, 0, 0], [39, 5, 39, 6, 0, 0, 0, 0], [39, 9, 39, 10, 0, 0, 0, 0], [40, 3, 40, 4, 0, 0, 0, 0], [40, 7, 40, 8, 0, 0, 0, 0], [49, 3, 49, 4, 0, 0, 0, 0], [49, 7, 49, 8, 0, 0, 0, 0], [50, 1, 50, 2, 0, 0, 0, 0], [50, 5, 50, 6, 0, 0, 0, 0], [50, 9, 50, 10, 0, 0, 0, 0], [59, 1, 59, 2, 0, 0, 0, 0], [59, 5, 59, 6, 0, 0, 0, 0], [59, 9, 59, 10, 0, 0, 0, 0], [60, 3, 60, 4, 0, 0, 0, 0], [60, 7, 60, 8, 0, 0, 0, 0], [69, 3, 69, 4, 0, 0, 0, 0], [69, 7, 69, 8, 0, 0, 0, 0], [70, 1, 70, 2, 0, 0, 0, 0], [70, 5, 70, 6, 0, 0, 0, 0], [70, 9, 70, 10, 0, 0, 0, 0], [79, 1, 79, 2, 0, 0, 0, 0], [79, 5, 79, 6, 0, 0, 0, 0], [79, 9, 79, 10, 0, 0, 0, 0], [80, 3, 80, 4, 0, 0, 0, 0], [80, 7, 80, 8, 0, 0, 0, 0], [89, 3, 89, 4, 0, 0, 0, 0], [89, 7, 89, 8, 0, 0, 0, 0], [90, 1, 90, 2, 0, 0, 0, 0], [90, 5, 90, 6, 0, 0, 0, 0], [90, 9, 90, 10, 0, 0, 0, 0], [99, 1, 99, 2, 0, 0, 0, 0], [99, 5, 99, 6, 0, 0, 0, 0], [99, 9, 99, 10, 0, 0, 0, 0], [0, 4, 0, 5, 0, 0, 0, 0], [0, 8, 0, 9, 0, 0, 0, 0], [1, 2, 1, 3, 0, 0, 0, 0], [1, 6, 1, 7, 0, 0, 0, 0], [2, 4, 2, 5, 0, 0, 0, 0], [2, 8, 2, 9, 0, 0, 0, 0], [3, 2, 3, 3, 0, 0, 0, 0], [3, 6, 3, 7, 0, 0, 0, 0], [4, 4, 4, 5, 0, 0, 0, 0], [4, 8, 4, 9, 0, 0, 0, 0], [5, 2, 5, 3, 0, 0, 0, 0], [5, 6, 5, 7, 0, 0, 0, 0], [6, 4, 6, 5, 0, 0, 0, 0], [6, 8, 6, 9, 0, 0, 0, 0], [7, 2, 7, 3, 0, 0, 0, 0], [7, 6, 7, 7, 0, 0, 0, 0], [8, 4, 8, 5, 0, 0, 0, 0], [8, 8, 8, 9, 0, 0, 0, 0], [9, 2, 9, 3, 0, 0, 0, 0], [9, 6, 9, 7, 0, 0, 0, 0], [90, 2, 90, 3, 0, 0, 0, 0], [90, 6, 90, 7, 0, 0, 0, 0], [91, 4, 91, 5, 0, 0, 0, 0], [91, 8, 91, 9, 0, 0, 0, 0], [92, 2, 92, 3, 0, 0, 0, 0], [92, 6, 92, 7, 0, 0, 0, 0], [93, 4, 93, 5, 0, 0, 0, 0], [93, 8, 93, 9, 0, 0, 0, 0], [94, 2, 94, 3, 0, 0, 0, 0], [94, 6, 94, 7, 0, 0, 0, 0], [95, 4, 95, 5, 0, 0, 0, 0], [95, 8, 95, 9, 0, 0, 0, 0], [96, 2, 96, 3, 0, 0, 0, 0], [96, 6, 96, 7, 0, 0, 0, 0], [97, 4, 97, 5, 0, 0, 0, 0], [97, 8, 97, 9, 0, 0, 0, 0], [98, 2, 98, 3, 0, 0, 0, 0], [98, 6, 98, 7, 0, 0, 0, 0], [99, 4, 99, 5, 0, 0, 0, 0], [99, 8, 99, 9, 0, 0, 0, 0], [1, 1, 0, 0, 0, 1, 0, 0], [0, 0, 1, 2, 0, 0, 0, 2], [1, 3, 0, 0, 0, 2, 3, 0, 0], [0, 0, 1, 4, 0, 0, 2, 4], [1, 5, 0, 0, 0, 5, 0, 0], [0, 0, 1, 6, 0, 0, 0, 6], [1, 7, 0, 0, 2, 7, 0, 0], [0, 0, 1, 8, 0, 0, 2, 8], [1, 9, 0, 0, 0, 9, 0, 0], [0, 0, 1, 10, 0, 0, 0, 10], [3, 1, 0, 0, 2, 1, 0, 0], [0, 0, 3, 2, 0, 0, 2, 2], [3, 3, 0, 0, 0, 4, 3, 0, 0], [0, 0, 3, 4, 0, 0, 4, 4], [3, 5, 0, 0, 2, 5, 0, 0], [0, 0, 3, 6, 0, 0, 2, 6], [3, 7, 0, 0, 4, 7, 0, 0], [0, 0, 3, 8, 0, 0, 4, 8], [3, 9, 0, 0, 0, 2, 9, 0, 0], [0, 0, 3, 10, 0, 0, 2, 10], [5, 1, 0, 0, 4, 1, 0, 0], [0, 0, 5, 2, 0, 0, 4, 2], [5, 3, 0, 0, 6, 3, 0, 0], [0, 0, 5, 4, 0, 0, 6, 4], [5, 5, 0, 0, 4, 5, 0, 0], [0, 0, 5, 6, 0, 0, 4, 6], [5, 7, 0, 0, 6, 7, 0, 0], [0, 0, 5, 8, 0, 0, 6, 8], [5, 9, 0, 0, 4, 9, 0, 0], [0, 0, 5, 10, 0, 0, 4, 10], [7, 1, 0, 0, 6, 1, 0, 0], [0, 0, 7, 2, 0, 0, 6, 2], [7, 3, 0, 0, 8, 3, 0, 0], [0, 0, 7, 4, 0, 0, 8, 4], [7, 5, 0, 0, 6, 5, 0, 0], [0, 0, 7, 6, 0, 0, 6, 6], [7, 7, 0, 0, 8, 7, 0, 0], [0, 0, 7, 8, 0, 0, 8, 8], [7, 9, 0, 0, 6, 9, 0, 0], [0, 0, 7, 10, 0, 0, 6, 10], [9, 1, 0, 0, 8, 1, 0, 0], [0, 0, 9, 2, 0, 0, 8, 2], [9, 5, 0, 0, 8, 5, 0, 0], [0, 0, 9, 6, 0, 0, 8, 6], [9, 9, 0, 0, 8, 9, 0, 0], [0, 0, 9, 10, 0, 0, 8, 10], [11, 1, 0, 0, 12, 1, 0, 0], [0, 0, 11, 2, 0, 0, 12, 2], [11, 3, 0, 0, 10, 3, 0, 0], [0, 0, 11, 4, 0, 0, 10, 4], [11, 5, 0, 0, 12, 5, 0, 0], [0, 0, 11, 6, 0, 0, 12, 6], [11, 7, 0, 0, 10, 7, 0, 0], [0, 0, 11, 8, 0, 0, 10, 8], [11, 9, 0, 0, 12, 9, 0, 0], [0, 0, 11, 10, 0, 0, 12, 10], [13, 1, 0, 0, 14, 1, 0, 0], [0, 0, 13, 2, 0, 0, 14, 2], [13, 3, 0, 0, 12, 3, 0, 0], [0, 0, 13, 4, 0, 0, 12, 4], [13, 5, 0, 0, 14, 5, 0, 0], [0, 0, 13, 6, 0, 0, 14, 6], [13, 7, 0, 0, 12, 7, 0, 0], [0, 0, 13, 8, 0, 0, 12, 8], [13, 9, 0, 0, 14, 9, 0, 0], [0, 0, 13, 10, 0, 0, 14, 10], [15, 1, 0, 0, 16, 1, 0, 0], [0, 0, 15, 2, 0, 0, 16, 2], [15, 3, 0, 0, 14, 3, 0, 0], [0, 0, 15, 4, 0, 0, 14, 4], [15, 5, 0, 0, 16, 5, 0, 0], [0, 0, 15, 6, 0, 0, 16, 6], [15, 7, 0, 0, 14, 7, 0, 0], [0, 0, 15, 8, 0, 0, 14, 8], [15, 9, 0, 0, 16, 9, 0, 0], [0, 0, 15, 10, 0, 0, 16, 10], [17, 1, 0, 0, 18, 1, 0, 0], [0, 0, 17, 2, 0, 0, 18, 2], [17, 3, 0, 0, 16, 3, 0, 0], [0, 0, 17, 4, 0, 0, 16, 4], [17, 5, 0, 0, 18, 5, 0, 0], [0, 0, 17, 6, 0, 0, 18, 6], [17, 7, 0, 0, 16, 7, 0, 0], [0, 0, 17, 8, 0, 0, 16, 8], [17, 9, 0, 0, 18, 9, 0, 0], [0, 0, 17, 10, 0, 0, 18, 10], [19, 3, 0, 0, 18, 3, 0, 0], [0, 0, 19, 4, 0, 0, 18, 4], [19, 7, 0, 0, 18, 7, 0, 0], [0, 0, 19, 8, 0, 0, 18, 8], [21, 1, 0, 0, 20, 1, 0, 0], [0, 0, 21, 2, 0, 0, 20, 2], [21, 3, 0, 0, 22, 3, 0, 0], [0, 0, 21, 4, 0, 0, 22, 4], [21, 5, 0, 0, 20, 5, 0, 0], [0, 0, 21, 6, 0, 0, 20, 6], [21, 7, 0, 0, 22, 7, 0, 0], [0, 0, 21, 8, 0, 0, 22, 8], [21, 9, 0, 0, 20, 9, 0, 0], [0, 0, 21, 10, 0, 0, 20, 10], [23, 1, 0, 0, 22, 1, 0, 0], [0, 0, 23, 2, 0, 0, 22, 2], [23, 3, 0, 0, 24, 3, 0, 0], [0, 0, 23, 4, 0, 0, 24, 4], [23, 5, 0, 0, 22, 5, 0, 0], [0, 0, 23, 6, 0, 0, 22, 6], [23, 7, 0, 0, 24, 7, 0, 0], [0, 0, 23, 8, 0, 0, 24, 8], [23, 9, 0, 0, 22, 9, 0, 0], [0, 0, 23, 10, 0, 0, 22, 10], [25, 1, 0, 0, 24, 1, 0, 0], [0, 0, 25, 2, 0, 0, 24, 2], [25, 3, 0, 0, 26, 3, 0, 0], [0, 0, 25, 4, 0, 0, 26, 4], [25, 5, 0, 0, 24, 5, 0, 0], [0, 0, 25, 6, 0, 0, 24, 6], [25, 7, 0, 0, 26, 7, 0, 0], [0, 0, 25, 8, 0, 0, 26, 8], [25, 9, 0, 0, 24, 9, 0, 0], [0, 0, 25, 10, 0, 0, 24, 10], [27, 1, 0, 0, 26, 1, 0, 0], [0, 0, 27, 2, 0, 0, 26, 2], [27, 3, 0, 0, 28, 3, 0, 0], [0, 0, 27, 4, 0, 0, 28, 4], [27, 5, 0, 0, 26, 5, 0, 0], [0, 0, 27, 6, 0, 0, 26, 6], [27, 7, 0, 0, 28, 7, 0, 0], [0, 0, 27, 8, 0, 0, 28, 8], [27, 9, 0, 0, 26, 9, 0, 0], [0, 0, 27, 10, 0, 0, 26, 10], [29, 1, 0, 0, 28, 1, 0, 0], [0, 0, 29, 2, 0, 0, 28, 2], [29, 5, 0, 0, 28, 5, 0, 0], [0, 0, 29, 6, 0, 0, 28, 6], [29, 9, 0, 0, 28, 9, 0, 0], [0, 0, 29, 10, 0, 0, 28, 10], [31, 1, 0, 0, 32, 1, 0, 0], [0, 0, 31, 2, 0, 0, 32, 2], [31, 3, 0, 0, 30, 3, 0, 0], [0, 0, 31, 4, 0, 0, 30, 4], [31, 5, 0, 0, 32, 5, 0, 0], [0, 0, 31, 6, 0, 0, 32, 6], [31, 7, 0, 0, 30, 7, 0, 0], [0, 0, 31, 8, 0, 0, 30, 8], [31, 9, 0, 0, 32, 9, 0, 0], [0, 0, 31, 10, 0, 0, 32, 10], [33, 1, 0, 0, 34, 1, 0, 0], [0, 0, 33, 2, 0, 0, 34, 2], [33, 3, 0, 0, 32, 3, 0, 0], [0, 0, 33, 4, 0, 0, 32, 4], [33, 5, 0, 0, 34, 5, 0, 0], [0, 0, 33, 6, 0, 0, 34, 6], [33, 7, 0, 0, 32, 7, 0, 0], [0, 0, 33, 8, 0, 0, 32, 8], [33, 9, 0, 0, 34, 9, 0, 0], [0, 0, 33, 10, 0, 0, 34, 10], [35, 1, 0, 0, 36, 1, 0, 0], [0, 0, 35, 2, 0, 0, 36, 2], [35, 3, 0, 0, 34, 3, 0, 0], [0, 0, 35, 4, 0, 0, 34, 4], [35, 5, 0, 0, 36, 5, 0, 0], [0, 0, 35, 6, 0, 0, 36, 6], [35, 7, 0, 0, 34, 7, 0, 0], [0, 0, 35, 8, 0, 0, 34, 8], [35, 9, 0, 0, 36, 9, 0, 0], [0, 0, 35, 10, 0, 0, 36, 10], [37, 1, 0, 0, 38, 1, 0, 0], [0, 0, 37, 2, 0, 0, 38, 2], [37, 3, 0, 0, 36, 3, 0, 0], [0, 0, 37, 4, 0, 0, 36, 4], [37, 5, 0, 0, 38, 5, 0, 0], [0, 0, 37, 6, 0, 0, 38, 6], [37, 7, 0, 0, 36, 7, 0, 0], [0, 0, 37, 8, 0, 0, 36, 8], [37, 9, 0, 0, 38, 9, 0, 0], [0, 0, 37, 10, 0, 0, 38, 10], [39, 3, 0, 0, 38, 3, 0, 0], [0, 0, 39, 4, 0, 0, 38, 4], [39, 7, 0, 0, 38, 7, 0, 0], [0, 0, 39, 8, 0, 0, 38, 8], [41, 1, 0, 0, 40, 1, 0, 0], [0, 0, 41, 2, 0, 0, 40, 2], [41, 3, 0, 0, 42, 3, 0, 0], [0, 0, 41, 4, 0, 0, 42, 4], [41, 5, 0, 0, 40, 5, 0, 0], [0, 0, 41, 6, 0, 0, 40, 6], [41, 7, 0, 0, 42, 7, 0, 0], [0, 0, 41, 8, 0, 0, 42, 8], [41, 9, 0, 0, 40, 9, 0, 0], [0, 0, 41, 10, 0, 0, 40, 10], [43, 1, 0, 0, 42, 1, 0, 0], [0, 0, 43, 2, 0, 0, 42, 2], [43, 3, 0, 0, 44, 3, 0, 0], [0, 0, 43, 4, 0, 0, 44, 4], [43, 5, 0, 0, 42, 5, 0, 0], [0, 0, 43, 6, 0, 0, 42, 6], [43, 7, 0, 0, 44, 7, 0, 0], [0, 0, 43, 8, 0, 0, 44, 8], [43, 9, 0, 0, 42, 9, 0, 0], [0, 0, 43, 10, 0, 0, 42, 10], [45, 1, 0, 0, 44, 1, 0, 0], [0, 0, 45, 2, 0, 0, 44, 2], [45, 3, 0, 0, 46, 3, 0, 0], [0, 0, 45, 4, 0, 0, 46, 4], [45, 5, 0, 0, 44, 5, 0, 0], [0, 0, 45, 6, 0, 0, 44, 6], [45, 7, 0, 0, 46, 7, 0, 0], [0, 0, 45, 8, 0, 0, 46, 8], [45, 9, 0, 0, 44, 9, 0, 0], [0, 0, 45, 10, 0, 0, 44, 10], [47, 1, 0, 0, 46, 1, 0, 0], [0, 0, 47, 2, 0, 0, 46, 2], [47, 3, 0, 0, 48, 3, 0, 0], [0, 0, 47, 4, 0, 0, 48, 4], [47, 5, 0, 0, 46, 5, 0, 0], [0, 0, 47, 6, 0, 0, 46, 6], [47, 7, 0, 0, 48, 7, 0, 0], [0, 0, 47, 8, 0, 0, 48, 8], [47, 9, 0, 0, 46, 9, 0, 0], [0, 0, 47, 10, 0, 0, 46, 10], [49, 1, 0, 0, 48, 1, 0, 0], [0, 0, 49, 2, 0, 0, 48, 2], [49, 5, 0, 0, 48, 5, 0, 0], [0, 0, 49, 6, 0, 0, 48, 6], [49, 9, 0, 0, 48, 9, 0, 0], [0, 0, 49, 10, 0, 0, 48, 10], [51, 1, 0, 0, 52, 1, 0, 0], [0, 0, 51, 2, 0, 0, 52, 2], [51, 3, 0, 0, 50, 3, 0, 0], [0, 0, 51, 4, 0, 0, 50, 4], [51, 5, 0, 0, 52, 5, 0, 0], [0, 0, 51, 6, 0, 0, 52, 6], [51, 7, 0, 0, 50, 7, 0, 0], [0, 0, 51, 8, 0, 0, 50, 8], [51, 9, 0, 0, 52, 9, 0, 0], [0, 0, 51, 10, 0, 0, 52, 10], [53, 1, 0, 0, 54, 1, 0, 0], [0, 0, 53, 2, 0, 0, 54, 2], [53, 3, 0, 0, 52, 3, 0, 0], [0, 0, 53, 4, 0, 0, 52, 4], [53, 5, 0, 0, 54, 5, 0, 0], [0, 0, 53, 6, 0, 0, 54, 6], [53, 7, 0, 0, 52, 7, 0, 0], [0, 0, 53, 8, 0, 0, 52, 8], [53, 9, 0, 0, 54, 9, 0, 0], [0, 0, 53, 10, 0, 0, 54, 10], [55, 1, 0, 0, 56, 1, 0, 0], [0, 0, 55, 2, 0, 0, 56, 2], [55, 3, 0, 0, 54, 3, 0, 0], [0, 0, 55, 4, 0, 0, 54, 4], [55, 5, 0, 0, 56, 5, 0, 0], [0, 0, 55, 6, 0, 0, 56, 6], [55, 7, 0, 0, 54, 7, 0, 0], [0, 0, 55, 8, 0, 0, 54, 8], [55, 9, 0, 0, 56, 9, 0, 0], [0, 0, 55, 10, 0, 0, 56, 10], [57, 1, 0, 0, 58, 1, 0, 0], [0, 0, 57, 2, 0, 0, 58, 2], [57, 3, 0, 0, 56, 3, 0, 0], [0, 0, 57, 4, 0, 0, 56, 4], [57, 5, 0, 0, 58, 5, 0, 0], [0, 0, 57, 6, 0, 0, 58, 6], [57, 7, 0, 0, 56, 7, 0, 0], [0, 0, 57, 8, 0, 0, 56, 8], [57, 9, 0, 0, 58, 9, 0, 0], [0, 0, 57, 10, 0, 0, 58, 10], [59, 3, 0, 0, 58, 3, 0, 0], [0, 0, 59, 4, 0, 0, 58, 4], [59, 7, 0, 0, 58, 7, 0, 0], [0, 0, 59, 8, 0, 0, 58, 8], [61, 1, 0, 0, 60, 1, 0, 0], [0, 0, 61, 2, 0, 0, 60, 2], [61, 3, 0, 0, 62, 3, 0, 0], [0, 0, 61, 4, 0, 0, 62, 4], [61, 5, 0, 0, 60, 5, 0, 0], [0, 0, 61, 6, 0, 0, 60, 6], [61, 7, 0, 0, 62, 7, 0, 0], [0, 0, 61, 8, 0, 0, 62, 8], [61, 9, 0, 0, 60, 9, 0, 0], [0, 0, 61, 10, 0, 0, 60, 10], [63, 1, 0, 0, 62, 1, 0, 0], [0, 0, 63, 2, 0, 0, 62, 2], [63, 3, 0, 0, 64, 3, 0, 0], [0, 0, 63, 4, 0, 0, 64, 4], [63, 5, 0, 0, 62, 5, 0, 0], [0, 0, 63, 6, 0, 0, 62, 6], [63, 7, 0, 0, 64, 7, 0, 0], [0, 0, 63, 8, 0, 0, 64, 8], [63, 9, 0, 0, 62, 9, 0, 0], [0, 0, 63, 10, 0, 0, 62, 10], [65, 1, 0, 0, 64, 1, 0, 0], [0, 0, 65, 2, 0, 0, 64, 2], [65, 3, 0, 0, 66, 3, 0, 0], [0, 0, 65, 4, 0, 0, 66, 4], [65, 5, 0, 0, 64, 5, 0, 0], [0, 0, 65, 6, 0, 0, 64, 6], [65, 7, 0, 0, 66, 7, 0, 0], [0, 0, 65, 8, 0, 0, 66, 8], [65, 9, 0, 0, 64, 9, 0, 0], [0, 0, 65, 10, 0, 0, 64, 10], [67, 1, 0, 0, 66, 1, 0, 0], [0, 0, 67, 2, 0, 0, 66, 2], [67, 3, 0, 0, 68, 3, 0, 0], [0, 0, 67, 4, 0, 0, 68, 4], [67, 5, 0, 0, 66, 5, 0, 0], [0, 0, 67, 6, 0, 0, 66, 6], [67, 7, 0, 0, 68, 7, 0, 0], [0, 0, 67, 8, 0, 0, 68, 8], [67, 9, 0, 0, 66, 9, 0, 0], [0, 0, 67, 10, 0, 0, 66, 10], [69, 1, 0, 0, 68, 1, 0, 0], [0, 0, 69, 2, 0, 0, 68, 2], [69, 5, 0, 0, 68, 5, 0, 0], [0, 0, 69, 6, 0, 0, 68, 6], [69, 9, 0, 0, 68, 9, 0, 0], [0, 0, 69, 10, 0, 0, 68, 10], [71, 1, 0, 0, 72, 1, 0, 0], [0, 0, 71, 2, 0, 0, 72, 2], [71, 3, 0, 0, 70, 3, 0, 0], [0, 0, 71, 4, 0, 0, 70, 4], [71, 5, 0, 0, 72, 5, 0, 0], [0, 0, 71, 6, 0, 0, 72, 6], [71, 7, 0, 0, 70, 7, 0, 0], [0, 0, 71, 8, 0, 0, 70, 8], [71, 9, 0, 0, 72, 9, 0, 0], [0, 0, 71, 10, 0, 0, 72, 10], [73, 1, 0, 0, 74, 1, 0, 0], [0, 0, 73, 2, 0, 0, 74, 2], [73, 3, 0, 0, 72, 3, 0, 0], [0, 0, 73, 4, 0, 0, 72, 4], [73, 5, 0, 0, 74, 5, 0, 0], [0, 0, 73, 6, 0, 0, 74, 6], [73, 7, 0, 0, 72, 7, 0, 0], [0, 0, 73, 8, 0, 0, 72, 8], [73, 9, 0, 0, 74, 9, 0, 0], [0, 0, 73, 10, 0, 0, 74, 10], [75, 1, 0, 0, 76, 1, 0, 0], [0, 0, 75, 2,

TABLE 32-continued 0, 0, 76, 2], [75, 3, 0, 0, 74, 3, 0, 0], [0, 0, 75, 4, 0, 0, 74, 4], [75, 5, 0, 0, 76, 5, 0, 0], [0, 0, 75, 6, 0, 0, 76, 6], [75, 7, 0, 0, 74, 7, 0, 0], [0, 0, 75, 8, 0, 0, 74, 8], [75, 9, 0, 0, 76, 9, 0, 0], [0, 0, 75, 10, 0, 0, 76, 10], [77, 1, 0, 0, 78, 1, 0, 0], [0, 0, 77, 2, 0, 0, 78, 2], [77, 3, 0, 0, 76, 3, 0, 0], [0, 0, 77, 4, 0, 0, 76, 4], [77, 5, 0, 0, 78, 5, 0, 0], [0, 0, 77, 6, 0, 0, 78, 6], [77, 7, 0, 0, 76, 7, 0, 0], [0, 0, 77, 8, 0, 0, 76, 8], [77, 9, 0, 0, 78, 9, 0, 0], [0, 0, 77, 10, 0, 0, 78, 10], [79, 3, 0, 0, 78, 3, 0, 0], [0, 0, 79, 4, 0, 0, 78, 4], [79, 7, 0, 0, 78, 7, 0, 0], [0, 0, 79, 8, 0, 0, 78, 8], [81, 1, 0, 0, 80, 1, 0, 0], [0, 0, 81, 2, 0, 0, 80, 2], [81, 3, 0, 0, 82, 3, 0, 0], [0, 0, 81, 4, 0, 0, 82, 4], [81, 5, 0, 0, 80, 5, 0, 0], [0, 0, 81, 6, 0, 0, 80, 6], [81, 7, 0, 0, 82, 7, 0, 0], [0, 0, 81, 8, 0, 0, 82, 8], [81, 9, 0, 0, 80, 9, 0, 0], [0, 0, 81, 10, 0, 0, 80, 10], [83, 1, 0, 0, 82, 1, 0, 0], [0, 0, 83, 2, 0, 0, 82, 2], [83, 3, 0, 0, 84, 3, 0, 0], [0, 0, 83, 4, 0, 0, 84, 4], [83, 5, 0, 0, 82, 5, 0, 0], [0, 0, 83, 6, 0, 0, 82, 6], [83, 7, 0, 0, 84, 7, 0, 0], [0, 0, 83, 8, 0, 0, 84, 8], [83, 9, 0, 0, 82, 9, 0, 0], [0, 0, 83, 10, 0, 0, 82, 10], [85, 1, 0, 0, 84, 1, 0, 0], [0, 0, 85, 2, 0, 0, 84, 2], [85, 3, 0, 0, 86, 3, 0, 0], [0, 0, 85, 4, 0, 0, 86, 4], [85, 5, 0, 0, 84, 5, 0, 0], [0, 0, 85, 6, 0, 0, 84, 6], [85, 7, 0, 0, 86, 7, 0, 0], [0, 0, 85, 8, 0, 0, 86, 8], [85, 9, 0, 0, 84, 9, 0, 0], [0, 0, 85, 10, 0, 0, 84, 10], [87, 1, 0, 0, 86, 1, 0, 0], [0, 0, 87, 2, 0, 0, 86, 2], [87, 3, 0, 0, 88, 3, 0, 0], [0, 0, 87, 4, 0, 0, 88, 4], [87, 5, 0, 0, 86, 5, 0, 0], [0, 0, 87, 6, 0, 0, 86, 6], [87, 7, 0, 0, 88, 7, 0, 0], [0, 0, 87, 8, 0, 0, 88, 8], [87, 9, 0, 0, 86, 9, 0, 0], [0, 0, 87, 10, 0, 0, 86, 10], [89, 1, 0, 0, 88, 1, 0, 0], [0, 0, 89, 2, 0, 0, 88, 2], [89, 5, 0, 0, 88, 5, 0, 0], [0, 0, 89, 6, 0, 0, 88, 6], [89, 9, 0, 0, 88, 9, 0, 0], [0, 0, 89, 10, 0, 0, 88, 10], [91, 1, 0, 0, 92, 1, 0, 0], [0, 0, 91, 2, 0, 0, 92, 2], [91, 3, 0, 0, 90, 3, 0, 0], [0, 0, 91, 4, 0, 0, 90, 4], [91, 5, 0, 0, 92, 5, 0, 0], [0, 0, 91, 6, 0, 0, 92, 6], [91, 7, 0, 0, 90, 7, 0, 0], [0, 0, 91, 8, 0, 0, 90, 8], [91, 9, 0, 0, 92, 9, 0, 0], [0, 0, 91, 10, 0, 0, 92, 10], [93, 1, 0, 0, 94, 1, 0, 0], [0, 0, 93, 2, 0, 0, 94, 2], [93, 3, 0, 0, 92, 3, 0, 0], [0, 0, 93, 4, 0, 0, 92, 4], [93, 5, 0, 0, 94, 5, 0, 0], [0, 0, 93, 6, 0, 0, 94, 6], [93, 7, 0, 0, 92, 7, 0, 0], [0, 0, 93, 8, 0, 0, 92, 8], [93, 9, 0, 0, 94, 9, 0, 0], [0, 0, 93, 10, 0, 0, 94, 10], [95, 1, 0, 0, 96, 1, 0, 0], [0, 0, 95, 2, 0, 0, 96, 2], [95, 3, 0, 0, 94, 3, 0, 0], [0, 0, 95, 4, 0, 0, 94, 4], [95, 5, 0, 0, 96, 5, 0, 0], [0, 0, 95, 6, 0, 0, 96, 6], [95, 7, 0, 0, 94, 7, 0, 0], [0, 0, 95, 8, 0, 0, 94, 8], [95, 9, 0, 0, 96, 9, 0, 0], [0, 0, 95, 10, 0, 0, 96, 10], [97, 1, 0, 0, 98, 1, 0, 0], [0, 0, 97, 2, 0, 0, 98, 2], [97, 3, 0, 0, 96, 3, 0, 0], [0, 0, 97, 4, 0, 0, 96, 4], [97, 5, 0, 0, 98, 5, 0, 0], [0, 0, 97, 6, 0, 0, 98, 6], [97, 7, 0, 0, 96, 7, 0, 0], [0, 0, 97, 8, 0, 0, 96, 8], [97, 9, 0, 0, 98, 9, 0, 0], [0, 0, 97, 10, 0, 0, 98, 10], [99, 3, 0, 0, 98, 3, 0, 0], [0, 0, 99, 4, 0, 0, 98, 4], [99, 7, 0, 0, 98, 7, 0, 0], [0, 0, 99, 8, 0, 0, 98, 8], [2, 2, 0, 0, 19, 2, 0, 0], [0, 0, 3, 0, 0, 19, 3], [6, 6, 0, 0, 19, 6, 0, 0], [0, 0, 7, 0, 0, 19, 7], [2, 2, 0, 0, 17, 2, 0, 0], [0, 0, 2, 3, 0, 0, 17, 3], [2, 6, 0, 0, 17, 6, 0, 0], [0, 0, 2, 7, 0, 0, 17, 7], [4, 2, 0, 0, 15, 2, 0, 0], [0, 0, 4, 3, 0, 0, 15, 3], [4, 6, 0, 0, 15, 6, 0, 0], [0, 0, 4, 7, 0, 0, 15, 7], [6, 2, 0, 0, 13, 2, 0, 0], [0, 0, 6, 3, 0, 0, 13, 3], [6, 6, 0, 0, 13, 6, 0, 0], [0, 0, 6, 7, 0, 0, 13, 7], [8, 2, 0, 0, 11, 2, 0, 0], [0, 0, 8, 3, 0, 0, 11, 3], [8, 6, 0, 0, 11, 6, 0, 0], [0, 0, 8, 7, 0, 0, 11, 7], [10, 2, 0, 0, 29, 2, 0, 0], [0, 0, 10, 3, 0, 0, 29, 3], [10, 4, 0, 0, 9, 4, 0, 0], [0, 0, 10, 5, 0, 0, 9, 5], [10, 6, 0, 0, 29, 6, 0, 0], [0, 0, 10, 7, 0, 0, 29, 7], [10, 8, 0, 0, 9, 8, 0, 0], [0, 0, 10, 9, 0, 0, 9, 9], [12, 2, 0, 0, 27, 2, 0, 0], [0, 0, 12, 3, 0, 0, 27, 3], [12, 4, 0, 0, 7, 4, 0, 0], [0, 0, 12, 5, 0, 0, 7, 5], [12, 6, 0, 0, 27, 6, 0, 0], [0, 0, 12, 7, 0, 0, 27, 7], [12, 8, 0, 0, 7, 8, 0, 0], [0, 0, 12, 9, 0, 0, 7, 9], [14, 2, 0, 0, 25, 2, 0, 0], [0, 0, 14, 3, 0, 0, 25, 3], [14, 4, 0, 0, 5, 4, 0, 0], [0, 0, 14, 5, 0, 0, 5, 5], [14, 6, 0, 0, 25, 6, 0, 0], [0, 0, 14, 7, 0, 0, 25, 7], [14, 8, 0, 0, 5, 8, 0, 0], [0, 0, 14, 9, 0, 0, 5, 9], [16, 2, 0, 0, 23, 2, 0, 0], [0, 0, 16, 3, 0, 0, 23, 3], [16, 4, 0, 0, 3, 4, 0, 0], [0, 0, 16, 5, 0, 0, 3, 5], [16, 6, 0, 0, 23, 6, 0, 0], [0, 0, 16, 7, 0, 0, 23, 7], [16, 8, 0, 0, 3, 8, 0, 0], [0, 0, 16, 9, 0, 0, 3, 9], [18, 2, 0, 0, 21, 2, 0, 0], [0, 0, 18, 3, 0, 0, 21, 3], [18, 4, 0, 0, 1, 4, 0, 0], [0, 0, 18, 5, 0, 0, 1, 5], [18, 6, 0, 0, 21, 6, 0, 0], [0, 0, 18, 7, 0, 0, 21, 7], [18, 8, 0, 0, 1, 8, 0, 0], [0, 0, 18, 9, 0, 0, 1, 9], [20, 2, 0, 0, 39, 2, 0, 0], [0, 0, 20, 3, 0, 0, 39, 3], [20, 4, 0, 0, 19, 4, 0, 0], [0, 0, 20, 5, 0, 0, 19, 5], [20, 6, 0, 0, 39, 6, 0, 0], [0, 0, 20, 7, 0, 0, 39, 7], [20, 8, 0, 0, 19, 8, 0, 0], [0, 0, 20, 9, 0, 0, 19, 9], [22, 2, 0, 0, 37, 2, 0, 0], [0, 0, 22, 3, 0, 0, 37, 3], [22, 4, 0, 0, 17, 4, 0, 0], [0, 0, 22, 5, 0, 0, 17, 5], [22, 6, 0, 0, 37, 6, 0, 0], [0, 0, 22, 7, 0, 0, 37, 7], [22, 8, 0, 0, 17, 8, 0, 0], [0, 0, 22, 9, 0, 0, 17, 9], [24, 2, 0, 0, 35, 2, 0, 0], [0, 0, 24, 3, 0, 0, 35, 3], [24, 4, 0, 0, 15, 4, 0, 0], [0, 0, 24, 5, 0, 0, 15, 5], [24, 6, 0, 0, 35, 6, 0, 0], [0, 0, 24, 7, 0, 0, 35, 7], [24, 8, 0, 0, 15, 8, 0, 0], [0, 0, 24, 9, 0, 0, 15, 9], [26, 2, 0, 0, 33, 2, 0, 0], [0, 0, 26, 3, 0, 0, 33, 3], [26, 4, 0, 0, 13, 4, 0, 0], [0, 0, 26, 5, 0, 0, 13, 5], [26, 6, 0, 0, 33, 6, 0, 0], [0, 0, 26, 7, 0, 0, 33, 7], [26, 8, 0, 0, 13, 8, 0, 0], [0, 0, 26, 9, 0, 0, 13, 9], [28, 2, 0, 0, 31, 2, 0, 0], [0, 0, 28, 3, 0, 0, 31, 3], [28, 4, 0, 0, 11, 4, 0, 0], [0, 0, 28, 5, 0, 0, 11, 5], [28, 6, 0, 0, 31, 6, 0, 0], [0, 0, 28, 7, 0, 0, 31, 7], [28, 8, 0, 0, 11, 8, 0, 0], [0, 0, 28, 9, 0, 0, 11, 9], [30, 2, 0, 0, 49, 2, 0, 0], [0, 0, 30, 3, 0, 0, 49, 3], [30, 4, 0, 0, 29, 4, 0, 0], [0, 0, 30, 5, 0, 0, 29, 5], [30, 6, 0, 0, 49, 6, 0, 0], [0, 0, 30, 7, 0, 0, 49, 7], [30, 8, 0, 0, 29, 8, 0, 0], [0, 0, 30, 9, 0, 0, 29, 9], [32, 2, 0, 0, 47, 2, 0, 0], [0, 0, 32, 3, 0, 0, 47, 3], [32, 4, 0, 0, 27, 4, 0, 0], [0, 0, 32, 5, 0, 0, 27, 5], [32, 6, 0, 0, 47, 6, 0, 0], [0, 0, 32, 7, 0, 0, 47, 7], [32, 8, 0, 0, 27, 8, 0, 0], [0, 0, 32, 9, 0, 0, 27, 9], [34, 2, 0, 0, 45, 2, 0, 0], [0, 0, 34, 3, 0, 0, 45, 3], [34, 4, 0, 0, 25, 4, 0, 0], [0, 0, 34, 5, 0, 0, 25, 5], [34, 6, 0, 0, 45, 6, 0, 0], [0, 0, 34, 7, 0, 0, 45, 7], [34, 8, 0, 0, 25, 8, 0, 0], [0, 0, 34, 9, 0, 0, 25, 9], [36, 2, 0, 0, 43, 2, 0, 0], [0, 0, 36, 3, 0, 0, 43, 3], [36, 4, 0, 0, 23, 4, 0, 0], [0, 0, 36, 5, 0, 0, 23, 5], [36, 6, 0, 0, 43, 6, 0, 0], [0, 0, 36, 7, 0, 0, 43, 7], [36, 8, 0, 0, 23, 8, 0, 0], [0, 0, 36, 9, 0, 0, 23, 9], [38, 2, 0, 0, 41, 2, 0, 0], [0, 0, 38, 3, 0, 0, 41, 3], [38, 4, 0, 0, 21, 4, 0, 0], [0, 0, 38, 5, 0, 0, 21, 5], [38, 6, 0, 0, 41, 6, 0, 0], [0, 0, 38, 7, 0, 0, 41, 7], [38, 8, 0, 0, 21, 8, 0, 0], [0, 0, 38, 9, 0, 0, 21, 9], [40, 2, 0, 0, 59, 2, 0, 0], [0, 0, 40, 3, 0, 0, 59, 3], [40, 4, 0, 0, 39, 4, 0, 0], [0, 0, 40, 5, 0, 0, 39, 5], [40, 6, 0, 0, 59, 6, 0, 0], [0, 0, 40, 7, 0, 0, 59, 7], [40, 8, 0, 0, 39, 8, 0, 0], [0, 0, 40, 9, 0, 0, 39, 9], [42, 2, 0, 0, 57, 2, 0, 0], [0, 0, 42, 3, 0, 0, 57, 3], [42, 4, 0, 0, 37, 4, 0, 0], [0, 0, 42, 5, 0, 0, 37, 5], [42, 6, 0, 0, 57, 6, 0, 0], [0, 0, 42, 7, 0, 0, 57, 7], [42, 8, 0, 0, 37, 8, 0, 0], [0, 0, 42, 9, 0, 0, 37, 9], [44, 2, 0, 0, 55, 2, 0, 0], [0, 0, 44, 3, 0, 0, 55, 3], [44, 4, 0, 0, 35, 4, 0, 0], [0, 0, 44, 5, 0, 0, 35, 5], [44, 6, 0, 0, 55, 6, 0, 0], [0, 0, 44, 7, 0, 0, 55, 7], [44, 8, 0, 0, 35, 8, 0, 0], [0, 0, 44, 9, 0, 0, 35, 9], [46, 2, 0, 0, 53, 2, 0, 0], [0, 0, 46, 3, 0, 0, 53, 3], [46, 4, 0, 0, 33, 4, 0, 0], [0, 0, 46, 5, 0, 0, 33, 5], [46, 6, 0, 0, 53, 6, 0, 0], [0, 0, 46, 7, 0, 0, 53, 7], [46, 8, 0, 0, 33, 8, 0, 0], [0, 0, 46, 9, 0, 0, 33, 9], [48, 2, 0, 0, 51, 2, 0, 0], [0, 0, 48, 3, 0, 0, 51, 3], [48, 4, 0, 0, 31, 4, 0, 0], [0, 0, 48, 5, 0, 0, 31, 5], [48, 6, 0, 0, 51, 6, 0, 0], [0, 0, 48, 7, 0, 0, 51, 7], [48, 8, 0, 0, 31, 8, 0, 0], [0, 0, 48, 9, 0, 0, 31, 9], [50, 2, 0, 0, 69, 2, 0, 0], [0, 0, 50, 3, 0, 0, 69, 3], [50, 4, 0, 0, 49, 4, 0, 0], [0, 0, 50, 5, 0, 0, 49, 5], [50, 6, 0, 0, 69, 6, 0, 0], [0, 0, 50, 7, 0, 0, 69, 7], [50, 8, 0, 0, 49, 8, 0, 0], [0, 0, 50, 9, 0, 0, 49, 9], [52, 2, 0, 0, 67, 2, 0, 0], [0, 0, 52, 3, 0, 0, 67, 3], [52, 4, 0, 0, 47, 4, 0, 0], [0, 0, 52, 5, 0, 0, 47, 5], [52, 6, 0, 0, 67, 6, 0, 0], [0, 0, 52, 7, 0, 0, 67, 7], [52, 8, 0, 0, 47, 8, 0, 0], [0, 0, 52, 9, 0, 0, 47, 9], [54, 2, 0, 0, 65, 2, 0, 0], [0, 0, 54, 3, 0, 0, 65, 3], [54, 4, 0, 0, 45, 4, 0, 0], [0, 0, 54, 5, 0, 0, 45, 5], [54, 6, 0, 0, 65, 6, 0, 0], [0, 0, 54, 7, 0, 0, 65, 7], [54, 8, 0, 0, 45, 8, 0, 0], [0, 0, 54, 9, 0, 0, 45, 9], [56, 2, 0, 0, 63, 2, 0, 0], [0, 0, 56, 3, 0, 0, 63, 3], [56, 4, 0, 0, 43, 4, 0, 0], [0, 0, 56, 5, 0, 0, 43, 5], [56, 6, 0, 0, 63, 6, 0, 0], [0, 0, 56, 7, 0, 0, 63, 7], [56, 8, 0, 0, 43, 8, 0, 0], [0, 0, 56, 9, 0, 0, 43, 9], [58, 2, 0, 0, 61, 2, 0, 0], [0, 0, 58, 3, 0, 0, 61, 3], [58, 4, 0, 0, 41, 4, 0, 0], [0, 0, 58, 5, 0, 0, 41, 5], [58, 6, 0, 0, 61, 6, 0, 0], [0, 0, 58, 7, 0, 0, 61, 7], [58, 8, 0, 0, 41, 8, 0, 0], [0, 0, 58, 9, 0, 0, 41, 9], [60, 2, 0, 0, 79, 2, 0, 0], [0, 0, 60, 3, 0, 0, 79, 3], [60, 4, 0, 0, 59, 4, 0, 0], [0, 0, 60, 5, 0, 0, 59, 5], [60, 6, 0, 0, 79, 6, 0, 0], [0, 0, 60, 7, 0, 0, 79, 7], [60, 8, 0, 0, 59, 8, 0, 0], [0, 0, 60, 9, 0, 0, 59, 9], [62, 2, 0, 0, 77, 2, 0, 0], [0, 0, 62, 3, 0, 0, 77, 3], [62, 4, 0, 0, 57, 4, 0, 0], [0, 0, 62, 5, 0, 0, 57, 5], [62, 6, 0, 0, 77, 6, 0, 0], [0, 0, 62, 7, 0, 0, 77, 7], [62, 8, 0, 0, 57, 8, 0, 0], [0, 0, 62, 9, 0, 0, 57, 9], [64, 2, 0, 0, 75, 2, 0, 0], [0, 0, 64, 3, 0, 0, 75, 3], [64, 4, 0, 0, 55, 4, 0, 0], [0, 0, 64, 5, 0, 0, 55, 5], [64, 6, 0, 0, 75, 6, 0, 0], [0, 0, 64, 7, 0, 0, 75, 7], [64, 8, 0, 0, 55, 8, 0, 0], [0, 0, 64, 9, 0, 0, 55, 9], [66, 2, 0, 0, 73, 2, 0, 0], [0, 0, 66, 3, 0, 0, 73, 3], [66, 4, 0, 0, 53, 4, 0, 0], [0, 0, 66, 5, 0, 0, 53, 5], [66, 6, 0, 0, 73, 6, 0, 0], [0, 0, 66, 7, 0, 0, 73, 7], [66, 8, 0, 0, 53, 8, 0, 0], [0, 0, 66, 9, 0, 0, 53, 9], [68, 2, 0, 0, 71, 2, 0, 0], [0, 0, 68, 3, 0, 0, 71, 3], [68, 4, 0, 0, 51, 4, 0, 0], [0, 0, 68, 5, 0, 0, 51, 5], [68, 6, 0, 0, 71, 6, 0, 0], [0, 0, 68, 7, 0, 0, 71, 7], [68, 8, 0, 0, 51, 8, 0, 0], [0, 0, 68, 9, 0, 0, 51, 9], [70, 2, 0, 0, 89, 2, 0, 0], [0, 0, 70, 3, 0, 0, 89, 3], [70, 4, 0, 0, 69, 4, 0, 0], [0, 0, 70, 5, 0, 0, 69, 5], [70, 6, 0, 0, 89, 6, 0, 0], [0, 0, 70, 7, 0, 0, 89, 7], [70, 8, 0, 0, 69, 8, 0, 0], [0, 0, 70, 9, 0, 0, 69, 9], [72, 2, 0, 0, 87, 2, 0, 0], [0, 0, 72, 3, 0, 0, 87, 3], [72, 4, 0, 0, 67, 4, 0, 0], [0, 0, 72, 5, 0, 0, 67, 5], [72, 6, 0, 0, 87, 6, 0, 0], [0, 0, 72, 7, 0, 0, 87, 7], [72, 8, 0, 0, 67, 8, 0, 0], [0, 0, 72, 9, 0, 0, 67, 9], [74, 2, 0, 0, 85, 2, 0, 0], [0, 0, 74, 3, 0, 0, 85, 3], [74, 4, 0, 0, 65, 4, 0, 0], [0, 0, 74, 5, 0, 0, 65, 5], [74, 6, 0, 0, 85, 6, 0, 0], [0, 0, 74, 7, 0, 0, 85, 7], [74, 8, 0, 0, 65, 8, 0, 0], [0, 0, 74, 9, 0, 0, 65, 9], [76, 2, 0, 0, 83, 2, 0, 0], [0, 0, 76, 3, 0, 0, 83, 3], [76, 4, 0, 0, 63, 4, 0, 0], [0, 0, 76, 5, 0, 0, 63, 5], [76, 6, 0, 0, 83, 6, 0, 0], [0, 0, 76, 7, 0, 0, 83, 7], [76, 8, 0, 0, 63, 8, 0, 0], [0, 0, 76, 9, 0, 0, 63, 9], [78, 2, 0, 0, 81, 2, 0, 0], [0, 0, 78, 3, 0, 0, 81, 3], [78, 4, 0, 0, 61, 4, 0, 0], [0, 0, 78, 5, 0, 0, 61, 5], [78, 6, 0, 0, 81, 6, 0, 0], [0, 0, 78, 7, 0, 0, 81, 7], [78, 8, 0, 0, 61, 8, 0, 0], [0, 0, 78, 9, 0, 0, 61, 9], [80, 2, 0, 0, 99, 2, 0, 0], [0, 0, 80, 3, 0, 0, 99, 3], [80, 4, 0, 0, 79, 4, 0, 0], [0, 0, 80, 5, 0, 0, 79, 5], [80, 6, 0, 0, 99, 6, 0, 0], [0, 0, 80, 7, 0, 0, 99, 7], [80, 8, 0, 0, 79, 8, 0, 0], [0, 0, 80, 9, 0, 0, 79, 9], [82, 2, 0, 0, 97, 2, 0, 0], [0, 0, 82, 3, 0, 0, 97, 3], [82, 4, 0, 0, 77, 4, 0, 0], [0, 0, 82, 5, 0, 0, 77, 5], [82, 6, 0, 0, 97, 6, 0, 0], [0, 0, 82, 7, 0, 0, 97, 7], [82, 8, 0, 0, 77, 8, 0, 0], [0, 0, 82, 9, 0, 0, 77, 9], [84, 2, 0, 0, 95, 2, 0, 0], [0, 0, 84, 3, 0, 0, 95, 3], [84, 4, 0, 0, 75, 4, 0, 0], [0, 0, 84, 5, 0, 0, 75, 5], [84, 6, 0, 0, 95, 6, 0, 0], [0, 0, 84, 7, 0, 0, 95, 7], [84, 8, 0, 0, 75, 8, 0, 0], [0, 0, 84, 9, 0, 0, 75, 9], [86, 2, 0, 0, 93, 2, 0, 0], [0, 0, 86, 3, 0, 0, 93, 3], [86, 4, 0, 0, 73, 4, 0, 0], [0, 0, 86, 5, 0, 0, 73, 5], [86, 6, 0, 0, 93, 6, 0, 0], [0, 0, 86, 7, 0, 0, 93, 7], [86, 8, 0, 0, 73, 8, 0, 0], [0, 0, 86, 9, 0, 0, 73, 9], [88, 2, TABLE 32-continued 0, 0, 91, 2, 0, 0], [0, 0, 88, 3, 0, 0, 91, 3], [88, 4, 0, 0, 71, 4, 0, 0], [0, 0, 88, 5, 0, 0, 71, 5], [88, 6, 0, 0, 91, 6, 0, 0], [0, 0, 88, 7, 0, 0, 91, 7], [88, 8, 0, 0, 71, 8, 0, 0], [0, 0, 88, 9, 0, 0, 71, 9], [90, 4, 0, 0, 89, 4, 0, 0], [0, 0, 90, 5, 0, 0, 89, 5], [90, 8, 0, 0, 89, 8, 0, 0], [0, 0, 90, 9, 0, 0, 89, 9], [92, 4, 0, 0, 87, 4, 0, 0], [0, 0, 92, 5, 0, 0, 87, 5], [92, 8, 0, 0, 87, 8, 0, 0], [0, 0, 92, 9, 0, 0, 87, 9], [94, 4, 0, 0, 85, 4, 0, 0], [0, 0, 94, 5, 0, 0, 85, 5], [94, 8, 0, 0, 85, 8, 0, 0], [0, 0, 94, 9, 0, 0, 85, 9], [96, 4, 0, 0, 83, 4, 0, 0], [0, 0, 96, 5, 0, 0, 83, 5], [96, 8, 0, 0, 83, 8, 0, 0], [0, 0, 96, 9, 0, 0, 83, 9], [98, 4, 0, 0, 81, 4, 0, 0], [0, 0, 98, 5, 0, 0, 81, 5], [98, 8, 0, 0, 81, 8, 0, 0], [0, 0, 98, 9, 0, 0, 81, 9], [1, 1, 0, 0, 0, 1, 0, 2], [0, 0, 1, 2, 0, 1, 0, 2], [1, 1, 1, 2, 0, 0, 0, 2], [1, 1, 1, 2, 0, 1, 0, 0], [1, 3, 0, 0, 2, 3, 2, 4], [0, 0, 1, 4, 2, 3, 2, 4], [1, 3, 1, 4, 0, 0, 2, 4], [1, 3, 1, 4, 2, 3, 0, 0], [1, 5, 0, 0, 0, 5, 0, 6], [0, 0, 1, 6, 0, 5, 0, 6], [1, 5, 1, 6, 0, 0, 0, 6], [1, 5, 1, 6, 0, 5, 0, 0], [1, 7, 0, 0, 2, 7, 2, 8], [0, 0, 1, 8, 2, 7, 2, 8], [1, 7, 1, 8, 0, 0, 2, 8], [1, 7, 1, 8, 2, 7, 0, 0], [1, 9, 0, 0, 0, 9, 0, 10], [0, 0, 1, 10, 0, 9, 0, 10], [1, 9, 1, 10, 0, 0, 0, 10], [1, 9, 1, 10, 0, 9, 0, 0], [3, 1, 0, 0, 2, 1, 2, 2], [0, 0, 3, 2, 2, 1, 2, 2], [3, 1, 3, 2, 0, 0, 2, 2], [3, 1, 3, 2, 2, 1, 0, 0], [3, 3, 0, 0, 4, 3, 4, 4], [0, 0, 3, 4, 4, 3, 4, 4], [3, 3, 3, 4, 0, 0, 4, 4], [3, 3, 3, 4, 4, 3, 0, 0], [3, 5, 0, 0, 2, 5, 2, 6], [0, 0, 3, 6, 2, 5, 2, 6], [3, 5, 3, 6, 0, 0, 2, 6], [3, 5, 3, 6, 2, 5, 0, 0], [3, 7, 0, 0, 4, 7, 4, 8], [0, 0, 3, 8, 4, 7, 4, 8], [3, 7, 3, 8, 0, 0, 4, 8], [3, 7, 3, 8, 4, 7, 0, 0], [3, 9, 0, 0, 2, 9, 2, 10], [0, 0, 3, 10, 2, 9, 2, 10], [3, 9, 3, 10, 0, 0, 2, 10], [3, 9, 3, 10, 2, 9, 0, 0], [5, 1, 0, 0, 4, 1, 4, 2], [0, 0, 5, 2, 4, 1, 4, 2], [5, 1, 5, 2, 0, 0, 4, 2], [5, 1, 5, 2, 4, 1, 0, 0], [5, 3, 0, 0, 6, 3, 6, 4], [0, 0, 5, 4, 6, 3, 6, 4], [5, 3, 5, 4, 0, 0, 6, 4], [5, 3, 5, 4, 6, 3, 0, 0], [5, 5, 0, 0, 4, 5, 4, 6], [0, 0, 5, 6, 4, 5, 4, 6], [5, 5, 5, 6, 0, 0, 4, 6], [5, 5, 5, 6, 4, 5, 0, 0], [5, 7, 0, 0, 6, 7, 6, 8], [0, 0, 5, 8, 6, 7, 6, 8], [5, 7, 5, 8, 0, 0, 6, 8], [5, 7, 5, 8, 6, 7, 0, 0], [5, 9, 0, 0, 4, 9, 4, 10], [0, 0, 5, 10, 4, 9, 4, 10], [5, 9, 5, 10, 0, 0, 4, 10], [5, 9, 5, 10, 4, 9, 0, 0], [7, 1, 0, 0, 6, 1, 6, 2], [0, 0, 7, 2, 6, 1, 6, 2], [7, 1, 7, 2, 0, 0, 6, 2], [7, 1, 7, 2, 6, 1, 0, 0], [7, 3, 0, 0, 8, 3, 8, 4], [0, 0, 7, 4, 8, 3, 8, 4], [7, 3, 7, 4, 0, 0, 8, 4], [7, 3, 7, 4, 8, 3, 0, 0], [7, 5, 0, 0, 6, 5, 6, 6], [0, 0, 7, 6, 6, 5, 6, 6], [7, 5, 7, 6, 0, 0, 6, 6], [7, 5, 7, 6, 6, 5, 0, 0], [7, 7, 0, 0, 8, 7, 8, 8], [0, 0, 7, 8, 8, 7, 8, 8], [7, 7, 7, 8, 0, 0, 8, 8], [7, 7, 7, 8, 8, 7, 0, 0], [7, 9, 0, 0, 6, 9, 6, 10], [0, 0, 7, 10, 6, 9, 6, 10], [7, 9, 7, 10, 0, 0, 6, 10], [7, 9, 7, 10, 6, 9, 0, 0], [9, 1, 0, 0, 8, 1, 8, 2], [0, 0, 9, 2, 8, 1, 8, 2], [9, 1, 9, 2, 0, 0, 8, 2], [9, 1, 9, 2, 8, 1, 0, 0], [9, 5, 0, 0, 8, 5, 8, 6], [0, 0, 9, 6, 8, 5, 8, 6], [9, 5, 9, 6, 0, 0, 8, 6], [9, 5, 9, 6, 8, 5, 0, 0], [9, 9, 0, 0, 8, 9, 8, 10], [0, 0, 9, 10, 8, 9, 8, 10], [9, 9, 9, 10, 0, 0, 8, 10], [9, 9, 9, 10, 8, 9, 0, 0], [11, 1, 0, 0, 12, 1, 12, 2], [0, 0, 11, 2, 12, 1, 12, 2], [11, 1, 11, 2, 0, 0, 12, 2], [11, 1, 11, 2, 12, 1, 0, 0], [11, 3, 0, 0, 10, 3, 10, 4], [0, 0, 11, 4, 10, 3, 10, 4], [11, 3, 11, 4, 0, 0, 10, 4], [11, 3, 11, 4, 10, 3, 0, 0], [11, 5, 0, 0, 12, 5, 12, 6], [0, 0, 11, 6, 12, 5, 12, 6], [11, 5, 11, 6, 0, 0, 12, 6], [11, 5, 11, 6, 12, 5, 0, 0], [11, 7, 0, 0, 10, 7, 10, 8], [0, 0, 11, 8, 10, 7, 10, 8], [11, 7, 11, 8, 0, 0, 10, 8], [11, 7, 11, 8, 10, 7, 0, 0], [11, 9, 0, 0, 12, 9, 12, 10], [0, 0, 11, 10, 12, 9, 12, 10], [11, 9, 11, 10, 0, 0, 12, 10], [11, 9, 11, 10, 12, 9, 0, 0], [13, 1, 0, 0, 14, 1, 14, 2], [0, 0, 13, 2, 14, 1, 14, 2], [13, 1, 13, 2, 0, 0, 14, 2], [13, 1, 13, 2, 14, 1, 0, 0], [13, 3, 0, 0, 12, 3, 12, 4], [0, 0, 13, 4, 12, 3, 12, 4], [13, 3, 13, 4, 0, 0, 12, 4], [13, 3, 13, 4, 12, 3, 0, 0], [13, 5, 0, 0, 14, 5, 14, 6], [0, 0, 13, 6, 14, 5, 14, 6], [13, 5, 13, 6, 0, 0, 14, 6], [13, 5, 13, 6, 14, 5, 0, 0], [13, 7, 0, 0, 12, 7, 12, 8], [0, 0, 13, 8, 12, 7, 12, 8], [13, 7, 13, 8, 0, 0, 12, 8], [13, 7, 13, 8, 12, 7, 0, 0], [13, 9, 0, 0, 14, 9, 14, 10], [0, 0, 13, 10, 14, 9, 14, 10], [13, 9, 13, 10, 0, 0, 14, 10], [13, 9, 13, 10, 14, 9, 0, 0], [15, 1, 0, 0, 16, 1, 16, 2], [0, 0, 15, 2, 16, 1, 16, 2], [15, 1, 15, 2, 0, 0, 16, 2], [15, 1, 15, 2, 16, 1, 0, 0], [15, 3, 0, 0, 14, 3, 14, 4], [0, 0, 15, 4, 14, 3, 14, 4], [15, 3, 15, 4, 0, 0, 14, 4], [15, 3, 15, 4, 14, 3, 0, 0], [15, 5, 0, 0, 16, 5, 16, 6], [0, 0, 15, 6, 16, 5, 16, 6], [15, 5, 15, 6, 0, 0, 16, 6], [15, 5, 15, 6, 16, 5, 0, 0], [15, 7, 0, 0, 14, 7, 14, 8], [0, 0, 15, 8, 14, 7, 14, 8], [15, 7, 15, 8, 0, 0, 14, 8], [15, 7, 15, 8, 14, 7, 0, 0], [15, 9, 0, 0, 16, 9, 16, 10], [0, 0, 15, 10, 16, 9, 16, 10], [15, 9, 15, 10, 0, 0, 16, 10], [15, 9, 15, 10, 16, 9, 0, 0], [17, 1, 0, 0, 18, 1, 18, 2], [0, 0, 17, 2, 18, 1, 18, 2], [17, 1, 17, 2, 0, 0, 18, 2], [17, 1, 17, 2, 18, 1, 0, 0], [17, 3, 0, 0, 16, 3, 16, 4], [0, 0, 17, 4, 16, 3, 16, 4], [17, 3, 17, 4, 0, 0, 16, 4], [17, 3, 17, 4, 16, 3, 0, 0], [17, 5, 0, 0, 18, 5, 18, 6], [0, 0, 17, 6, 18, 5, 18, 6], [17, 5, 17, 6, 0, 0, 18, 6], [17, 5, 17, 6, 18, 5, 0, 0], [17, 7, 0, 0, 16, 7, 16, 8], [0, 0, 17, 8, 16, 7, 16, 8], [17, 7, 17, 8, 0, 0, 16, 8], [17, 7, 17, 8, 16, 7, 0, 0], [17, 9, 0, 0, 18, 9, 18, 10], [0, 0, 17, 10, 18, 9, 18, 10], [17, 9, 17, 10, 0, 0, 18, 10], [17, 9, 17, 10, 18, 9, 0, 0], [19, 3, 0, 0, 18, 3, 18, 4], [0, 0, 19, 4, 18, 3, 18, 4], [19, 3, 19, 4, 0, 0, 18, 4], [19, 3, 19, 4, 18, 3, 0, 0], [19, 7, 0, 0, 18, 7, 18, 8], [0, 0, 19, 8, 18, 7, 18, 8], [19, 7, 19, 8, 0, 0, 18, 8], [19, 7, 19, 8, 18, 7, 0, 0], [21, 1, 0, 0, 20, 1, 20, 2], [0, 0, 21, 2, 20, 1, 20, 2], [21, 1, 21, 2, 0, 0, 20, 2], [21, 1, 21, 2, 20, 1, 0, 0], [21, 3, 0, 0, 22, 3, 22, 4], [0, 0, 21, 4, 22, 3, 22, 4], [21, 3, 21, 4, 0, 0, 22, 4], [21, 3, 21, 4, 22, 3, 0, 0], [21, 5, 0, 0, 20, 5, 20, 6], [0, 0, 21, 6, 20, 5, 20, 6], [21, 5, 21, 6, 0, 0, 20, 6], [21, 5, 21, 6, 20, 5, 0, 0], [21, 7, 0, 0, 22, 7, 22, 8], [0, 0, 21, 8, 22, 7, 22, 8], [21, 7, 21, 8, 0, 0, 22, 8], [21, 7, 21, 8, 22, 7, 0, 0], [21, 9, 0, 0, 20, 9, 20, 10], [0, 0, 21, 10, 20, 9, 20, 10], [21, 9, 21, 10, 0, 0, 20, 10], [21, 9, 21, 10, 20, 9, 0, 0], [23, 1, 0, 0, 22, 1, 22, 2], [0, 0, 23, 2, 22, 1, 22, 2], [23, 1, 23, 2, 0, 0, 22, 2], [23, 1, 23, 2, 22, 1, 0, 0], [23, 3, 0, 0, 24, 3, 24, 4], [0, 0, 23, 4, 24, 3, 24, 4], [23, 3, 23, 4, 0, 0, 24, 4], [23, 3, 23, 4, 24, 3, 0, 0], [23, 5, 0, 0, 22, 5, 22, 6], [0, 0, 23, 6, 22, 5, 22, 6], [23, 5, 23, 6, 0, 0, 22, 6], [23, 5, 23, 6, 22, 5, 0, 0], [23, 7, 0, 0, 24, 7, 24, 8], [0, 0, 23, 8, 24, 7, 24, 8], [23, 7, 23, 8, 0, 0, 24, 8], [23, 7, 23, 8, 24, 7, 0, 0], [23, 9, 0, 0, 22, 9, 22, 10], [0, 0, 23, 10, 22, 9, 22, 10], [23, 9, 23, 10, 0, 0, 22, 10], [23, 9, 23, 10, 22, 9, 0, 0], [25, 1, 0, 0, 24, 1, 24, 2], [0, 0, 25, 2, 24, 1, 24, 2], [25, 1, 25, 2, 0, 0, 24, 2], [25, 1, 25, 2, 24, 1, 0, 0], [25, 3, 0, 0, 26, 3, 26, 4], [0, 0, 25, 4, 26, 3, 26, 4], [25, 3, 25, 4, 0, 0, 26, 4], [25, 3, 25, 4, 26, 3, 0, 0], [25, 5, 0, 0, 24, 5, 24, 6], [0, 0, 25, 6, 24, 5, 24, 6], [25, 5, 25, 6, 0, 0, 24, 6], [25, 5, 25, 6, 24, 5, 0, 0], [25, 7, 0, 0, 26, 7, 26, 8], [0, 0, 25, 8, 26, 7, 26, 8], [25, 7, 25, 8, 0, 0, 26, 8], [25, 7, 25, 8, 26, 7, 0, 0], [25, 9, 0, 0, 24, 9, 24, 10], [0, 0, 25, 10, 24, 9, 24, 10], [25, 9, 25, 10, 0, 0, 24, 10], [25, 9, 25, 10, 24, 9, 0, 0], [27, 1, 0, 0, 26, 1, 26, 2], [0, 0, 27, 2, 26, 1, 26, 2], [27, 1, 27, 2, 0, 0, 26, 2], [27, 1, 27, 2, 26, 1, 0, 0], [27, 3, 0, 0, 28, 3, 28, 4], [0, 0, 27, 4, 28, 3, 28, 4], [27, 3, 27, 4, 0, 0, 28, 4], [27, 3, 27, 4, 28, 3, 0, 0], [27, 5, 0, 0, 26, 5, 26, 6], [0, 0, 27, 6, 26, 5, 26, 6], [27, 5, 27, 6, 0, 0, 26, 6], [27, 5, 27, 6, 26, 5, 0, 0], [27, 7, 0, 0, 28, 7, 28, 8], [0, 0, 27, 8, 28, 7, 28, 8], [27, 7, 27, 8, 0, 0, 28, 8], [27, 7, 27, 8, 28, 7, 0, 0], [27, 9, 0, 0, 26, 9, 26, 10], [0, 0, 27, 10, 26, 9, 26, 10], [27, 9, 27, 10, 0, 0, 26, 10], [27, 9, 27, 10, 26, 9, 0, 0], [29, 1, 0, 0, 28, 1, 28, 2], [0, 0, 29, 2, 28, 1, 28, 2], [29, 1, 29, 2, 0, 0, 28, 2], [29, 1, 29, 2, 28, 1, 0, 0], [29, 5, 0, 0, 28, 5, 28, 6], [0, 0, 29, 6, 28, 5, 28, 6], [29, 5, 29, 6, 0, 0, 28, 6], [29, 5, 29, 6, 28, 5, 0, 0], [29, 9, 0, 0, 28, 9, 28, 10], [0, 0, 29, 10, 28, 9, 28, 10], [29, 9, 29, 10, 0, 0, 28, 10], [29, 9, 29, 10, 28, 9, 0, 0], [31, 1, 0, 0, 32, 1, 32, 2], [0, 0, 31, 2, 32, 1, 32, 2], [31, 1, 31, 2, 0, 0, 32, 2], [31, 1, 31, 2, 32, 1, 0, 0], [31, 3, 0, 0, 30, 3, 30, 4], [0, 0, 31, 4, 30, 3, 30, 4], [31, 3, 31, 4, 0, 0, 30, 4], [31, 3, 31, 4, 30, 3, 0, 0], [31, 5, 0, 0, 32, 5, 32, 6], [0, 0, 31, 6, 32, 5, 32, 6], [31, 5, 31, 6, 0, 0, 32, 6], [31, 5, 31, 6, 32, 5, 0, 0], [31, 7, 0, 0, 30, 7, 30, 8], [0, 0, 31, 8, 30, 7, 30, 8], [31, 7, 31, 8, 0, 0, 30, 8], [31, 7, 31, 8, 30, 7, 0, 0], [31, 9, 0, 0, 32, 9, 32, 10], [0, 0, 31, 10, 32, 9, 32, 10], [31, 9, 31, 10, 0, 0, 32, 10], [31, 9, 31, 10, 32, 9, 0, 0], [33, 1, 0, 0, 34, 1, 34, 2], [0, 0, 33, 2, 34, 1, 34, 2], [33, 1, 33, 2, 0, 0, 34, 2], [33, 1, 33, 2, 34, 1, 0, 0], [33, 3, 0, 0, 32, 3, 32, 4], [0, 0, 33, 4, 32, 3, 32, 4], [33, 3, 33, 4, 0, 0, 32, 4], [33, 3, 33, 4, 32, 3, 0, 0], [33, 5, 0, 0, 34, 5, 34, 6], [0, 0, 33, 6, 34, 5, 34, 6], [33, 5, 33, 6, 0, 0, 34, 6], [33, 5, 33, 6, 34, 5, 0, 0], [33, 7, 0, 0, 32, 7, 32, 8], [0, 0, 33, 8, 32, 7, 32, 8], [33, 7, 33, 8, 0, 0, 32, 8], [33, 7, 33, 8, 32, 7, 0, 0], [33, 9, 0, 0, 34, 9, 34, 10], [0, 0, 33, 10, 34, 9, 34, 10], [33, 9, 33, 10, 0, 0, 34, 10], [33, 9, 33, 10, 34, 9, 0, 0], [35, 1, 0, 0, 36, 1, 36, 2], [0, 0, 35, 2, 36, 1, 36, 2], [35, 1, 35, 2, 0, 0, 36, 2], [35, 1, 35, 2, 36, 1, 0, 0], [35, 3, 0, 0, 34, 3, 34, 4], [0, 0, 35, 4, 34, 3, 34, 4], [35, 3, 35, 4, 0, 0, 34, 4], [35, 3, 35, 4, 34, 3, 0, 0], [35, 5, 0, 0, 36, 5, 36, 6], [0, 0, 35, 6, 36, 5, 36, 6], [35, 5, 35, 6, 0, 0, 36, 6], [35, 5, 35, 6, 36, 5, 0, 0], [35, 7, 0, 0, 34, 7, 34, 8], [0, 0, 35, 8, 34, 7, 34, 8], [35, 7, 35, 8, 0, 0, 34, 8], [35, 7, 35, 8, 34, 7, 0, 0], [35, 9, 0, 0, 36, 9, 36, 10], [0, 0, 35, 10, 36, 9, 36, 10], [35, 9, 35, 10, 0, 0, 36, 10], [35, 9, 35, 10, 36, 9, 0, 0], [37, 1, 0, 0, 38, 1, 38, 2], [0, 0, 37, 2, 38, 1, 38, 2], [37, 1, 37, 2, 0, 0, 38, 2], [37, 1, 37, 2, 38, 1, 0, 0], [37, 3, 0, 0, 36, 3, 36, 4], [0, 0, 37, 4, 36, 3, 36, 4], [37, 3, 37, 4, 0, 0, 36, 4], [37, 3, 37, 4, 36, 3, 0, 0], [37, 5, 0, 0, 38, 5, 38, 6], [0, 0, 37, 6, 38, 5, 38, 6], [37, 5, 37, 6, 0, 0, 38, 6], [37, 5, 37, 6, 38, 5, 0, 0], [37, 7, 0, 0, 36, 7, 36, 8], [0, 0, 37, 8, 36, 7, 36, 8], [37, 7, 37, 8, 0, 0, 36, 8], [37, 7, 37, 8, 36, 7, 0, 0], [37, 9, 0, 0, 38, 9, 38, 10], [0, 0, 37, 10, 38, 9, 38, 10], [37, 9, 37, 10, 0, 0, 38, 10], [37, 9, 37, 10, 38, 9, 0, 0], [39, 3, 0, 0, 38, 3, 38, 4], [0, 0, 39, 4, 38, 3, 38, 4], [39, 3, 39, 4, 0, 0, 38, 4], [39, 3, 39, 4, 38, 3, 0, 0], [39, 7, 0, 0, 38, 7, 38, 8], [0, 0, 39, 8, 38, 7, 38, 8], [39, 7, 39, 8, 0, 0, 38, 8], [39, 7, 39, 8, 38, 7, 0, 0], [41, 1, 0, 0, 40, 1, 40, 2], [0, 0, 41, 2, 40, 1, 40, 2], [41, 1, 41, 2, 0, 0, 40, 2], [41, 1, 41, 2, 40, 1, 0, 0], [41, 3, 0, 0, 42, 3, 42, 4], [0, 0, 41, 4, 42, 3, 42, 4], [41, 3, 41, 4, 0, 0, 42, 4], [41, 3, 41, 4, 42, 3, 0, 0], [41, 5, 0, 0, 40, 5, 40, 6], [0, 0, 41, 6, 40, 5, 40, 6], [41, 5, 41, 6, 0, 0, 40, 6], [41, 5, 41, 6, 40, 5, 0, 0], [41, 7, 0, 0, 42, 7, 42, 8], [0, 0, 41, 8, 42, 7, 42, 8], [41, 7, 41, 8, 0, 0, 42, 8], [41, 7, 41, 8, 42, 7, 0, 0], [41, 9, 0, 0, 40, 9, 40, 10], [0, 0, 41, 10, 40, 9, 40, 10], [41, 9, 41, 10, 0, 0, 40, 10], [41, 9, 41, 10, 40, 9, 0, 0], [43, 1, 0, 0, 42, 1, 42, 2], [0, 0, 43, 2, 42, 1, 42, 2], [43, 1, 43, 2, 0, 0, 42, 2], [43, 1, 43, 2, 42, 1, 0, 0], [43, 3, 0, 0, 44, 3, 44, 4], [0, 0, 43, 4, 44, 3, 44, 4], [43, 3, 43, 4, 0, 0, 44, 4], [43, 3, 43, 4, 44, 3, 0, 0], [43, 5, 0, 0, 42, 5, 42, 6], [0, 0, 43, 6, 42, 5, 42, 6], [43, 5, 43, 6, 0, 0, 42, 6], [43, 5, 43, 6, 42, 5, 0, 0], [43, 7, 0, 0, 44, 7, 44, 8], [0, 0, 43, 8, 44, 7, 44, 8], [43, 7, 43, 8, 0, 0, 44, 8], [43, 7, 43, 8, 44, 7, 0, 0], [43, 9, 0, 0, 42, 9, 42, 10], [0, 0, 43, 10, 42, 9, 42, 10], [43, 9, 43, 10, 0, 0, 42, 10], [43, 9, 43, 10, 42, 9, 0, 0], [45, 1, 0, 0, 44, 1, 44, 2], [0, 0, 45, 2, 44, 1, 44, 2], [45, 1, 45, 2, TABLE 32-continued 0, 0, 44, 2], [45, 1, 45, 2, 44, 1, 0, 0], [45, 3, 0, 0, 46, 3, 46, 4], [0, 0, 45, 4, 46, 3, 46, 4], [45, 3, 45, 4, 0, 0, 46, 4], [45, 3, 45, 4, 46, 3, 0, 0], [45, 5, 0, 0, 44, 5, 44, 6], [0, 0, 45, 6, 44, 5, 44, 6], [45, 5, 45, 6, 0, 0, 44, 6], [45, 5, 45, 6, 44, 5, 0, 0], [45, 7, 0, 0, 46, 7, 46, 8], [0, 0, 45, 8, 46, 7, 46, 8], [45, 7, 45, 8, 0, 0, 46, 8], [45, 7, 45, 8, 46, 7, 0, 0], [45, 9, 0, 0, 44, 9, 44, 10], [0, 0, 45, 10, 44, 9, 44, 10], [45, 9, 45, 10, 0, 0, 44, 10], [45, 9, 45, 10, 44, 9, 0, 0], [47, 1, 0, 0, 46, 1, 46, 2], [0, 0, 47, 2, 46, 1, 46, 2], [47, 1, 47, 2, 0, 0, 46, 2], [47, 1, 47, 2, 46, 1, 0, 0], [47, 3, 0, 0, 48, 3, 48, 4], [0, 0, 47, 4, 48, 3, 48, 4], [47, 3, 47, 4, 0, 0, 48, 4], [47, 3, 47, 4, 48, 3, 0, 0], [47, 5, 0, 0, 46, 5, 46, 6], [0, 0, 47, 6, 46, 5, 46, 6], [47, 5, 47, 6, 0, 0, 46, 6], [47, 5, 47, 6, 46, 5, 0, 0], [47, 7, 0, 0, 48, 7, 48, 8], [0, 0, 47, 8, 48, 7, 48, 8], [47, 7, 47, 8, 0, 0, 48, 8], [47, 7, 47, 8, 48, 7, 0, 0], [47, 9, 0, 0, 46, 9, 46, 10], [0, 0, 47, 10, 46, 9, 46, 10], [47, 9, 47, 10, 0, 0, 46, 10], [47, 9, 47, 10, 46, 9, 0, 0], [49, 1, 0, 0, 48, 1, 48, 2], [0, 0, 49, 2, 48, 1, 48, 2], [49, 1, 49, 2, 0, 0, 48, 2], [49, 1, 49, 2, 48, 1, 0, 0], [49, 5, 0, 0, 48, 5, 48, 6], [0, 0, 49, 6, 48, 5, 48, 6], [49, 5, 49, 6, 0, 0, 48, 6], [49, 5, 49, 6, 48, 5, 0, 0], [49, 9, 0, 0, 48, 9, 48, 10], [0, 0, 49, 10, 48, 9, 48, 10], [49, 9, 49, 10, 0, 0, 48, 10], [49, 9, 49, 10, 48, 9, 0, 0], [51, 1, 0, 0, 52, 1, 52, 2], [0, 0, 51, 2, 52, 1, 52, 2], [51, 1, 51, 2, 0, 0, 52, 2], [51, 1, 51, 2, 52, 1, 0, 0], [51, 3, 0, 0, 50, 3, 50, 4], [0, 0, 51, 4, 50, 3, 50, 4], [51, 3, 51, 4, 0, 0, 50, 4], [51, 3, 51, 4, 50, 3, 0, 0], [51, 5, 0, 0, 52, 5, 52, 6], [0, 0, 51, 6, 52, 5, 52, 6], [51, 5, 51, 6, 0, 0, 52, 6], [51, 5, 51, 6, 52, 5, 0, 0], [51, 7, 0, 0, 50, 7, 50, 8], [0, 0, 51, 8, 50, 7, 50, 8], [51, 7, 51, 8, 0, 0, 50, 8], [51, 7, 51, 8, 50, 7, 0, 0], [51, 9, 0, 0, 52, 9, 52, 10], [0, 0, 51, 10, 52, 9, 52, 10], [51, 9, 51, 10, 0, 0, 52, 10], [51, 9, 51, 10, 52, 9, 0, 0], [53, 1, 0, 0, 54, 1, 54, 2], [0, 0, 53, 2, 54, 1, 54, 2], [53, 1, 53, 2, 0, 0, 54, 2], [53, 1, 53, 2, 54, 1, 0, 0], [53, 3, 0, 0, 52, 3, 52, 4], [0, 0, 53, 4, 52, 3, 52, 4], [53, 3, 53, 4, 0, 0, 52, 4], [53, 3, 53, 4, 52, 3, 0, 0], [53, 5, 0, 0, 54, 5, 54, 6], [0, 0, 53, 6, 54, 5, 54, 6], [53, 5, 53, 6, 0, 0, 54, 6], [53, 5, 53, 6, 54, 5, 0, 0], [53, 7, 0, 0, 52, 7, 52, 8], [0, 0, 53, 8, 52, 7, 52, 8], [53, 7, 53, 8, 0, 0, 52, 8], [53, 7, 53, 8, 52, 7, 0, 0], [53, 9, 0, 0, 54, 9, 54, 10], [0, 0, 53, 10, 54, 9, 54, 10], [53, 9, 53, 10, 0, 0, 54, 10], [53, 9, 53, 10, 54, 9, 0, 0], [55, 1, 0, 0, 56, 1, 56, 2], [0, 0, 55, 2, 56, 1, 56, 2], [55, 1, 55, 2, 0, 0, 56, 2], [55, 1, 55, 2, 56, 1, 0, 0], [55, 3, 0, 0, 54, 3, 54, 4], [0, 0, 55, 4, 54, 3, 54, 4], [55, 3, 55, 4, 0, 0, 54, 4], [55, 3, 55, 4, 54, 3, 0, 0], [55, 5, 0, 0, 56, 5, 56, 6], [0, 0, 55, 6, 56, 5, 56, 6], [55, 5, 55, 6, 0, 0, 56, 6], [55, 5, 55, 6, 56, 5, 0, 0], [55, 7, 0, 0, 54, 7, 54, 8], [0, 0, 55, 8, 54, 7, 54, 8], [55, 7, 55, 8, 0, 0, 54, 8], [55, 7, 55, 8, 54, 7, 0, 0], [55, 9, 0, 0, 56, 9, 56, 10], [0, 0, 55, 10, 56, 9, 56, 10], [55, 9, 55, 10, 0, 0, 56, 10], [55, 9, 55, 10, 56, 9, 0, 0], [57, 1, 0, 0, 58, 1, 58, 2], [0, 0, 57, 2, 58, 1, 58, 2], [57, 1, 57, 2, 0, 0, 58, 2], [57, 1, 57, 2, 58, 1, 0, 0], [57, 3, 0, 0, 56, 3, 56, 4], [0, 0, 57, 4, 56, 3, 56, 4], [57, 3, 57, 4, 0, 0, 56, 4], [57, 3, 57, 4, 56, 3, 0, 0], [57, 5, 0, 0, 58, 5, 58, 6], [0, 0, 57, 6, 58, 5, 58, 6], [57, 5, 57, 6, 0, 0, 58, 6], [57, 5, 57, 6, 58, 5, 0, 0], [57, 7, 0, 0, 56, 7, 56, 8], [0, 0, 57, 8, 56, 7, 56, 8], [57, 7, 57, 8, 0, 0, 56, 8], [57, 7, 57, 8, 56, 7, 0, 0], [57, 9, 0, 0, 58, 9, 58, 10], [0, 0, 57, 10, 58, 9, 58, 10], [57, 9, 57, 10, 0, 0, 58, 10], [57, 9, 57, 10, 58, 9, 0, 0], [59, 3, 0, 0, 58, 3, 58, 4], [0, 0, 59, 4, 58, 3, 58, 4], [59, 3, 59, 4, 0, 0, 58, 4], [59, 3, 59, 4, 58, 3, 0, 0], [59, 7, 0, 0, 58, 7, 58, 8], [0, 0, 59, 8, 58, 7, 58, 8], [59, 7, 59, 8, 0, 0, 58, 8], [59, 7, 59, 8, 58, 7, 0, 0], [61, 1, 0, 0, 60, 1, 60, 2], [0, 0, 61, 2, 60, 1, 60, 2], [61, 1, 61, 2, 0, 0, 60, 2], [61, 1, 61, 2, 60, 1, 0, 0], [61, 3, 0, 0, 62, 3, 62, 4], [0, 0, 61, 4, 62, 3, 62, 4], [61, 3, 61, 4, 0, 0, 62, 4], [61, 3, 61, 4, 62, 3, 0, 0], [61, 5, 0, 0, 60, 5, 60, 6], [0, 0, 61, 6, 60, 5, 60, 6], [61, 5, 61, 6, 0, 0, 60, 6], [61, 5, 61, 6, 60, 5, 0, 0], [61, 7, 0, 0, 62, 7, 62, 8], [0, 0, 61, 8, 62, 7, 62, 8], [61, 7, 61, 8, 0, 0, 62, 8], [61, 7, 61, 8, 62, 7, 0, 0], [61, 9, 0, 0, 60, 9, 60, 10], [0, 0, 61, 10, 60, 9, 60, 10], [61, 9, 61, 10, 0, 0, 60, 10], [61, 9, 61, 10, 60, 9, 0, 0], [63, 1, 0, 0, 62, 1, 62, 2], [0, 0, 63, 2, 62, 1, 62, 2], [63, 1, 63, 2, 0, 0, 62, 2], [63, 1, 63, 2, 62, 1, 0, 0], [63, 3, 0, 0, 64, 3, 64, 4], [0, 0, 63, 4, 64, 3, 64, 4], [63, 3, 63, 4, 0, 0, 64, 4], [63, 3, 63, 4, 64, 3, 0, 0], [63, 5, 0, 0, 62, 5, 62, 6], [0, 0, 63, 6, 62, 5, 62, 6], [63, 5, 63, 6, 0, 0, 62, 6], [63, 5, 63, 6, 62, 5, 0, 0], [63, 7, 0, 0, 64, 7, 64, 8], [0, 0, 63, 8, 64, 7, 64, 8], [63, 7, 63, 8, 0, 0, 64, 8], [63, 7, 63, 8, 64, 7, 0, 0], [63, 9, 0, 0, 62, 9, 62, 10], [0, 0, 63, 10, 62, 9, 62, 10], [63, 9, 63, 10, 0, 0, 62, 10], [63, 9, 63, 10, 62, 9, 0, 0], [65, 1, 0, 0, 64, 1, 64, 2], [0, 0, 65, 2, 64, 1, 64, 2], [65, 1, 65, 2, 0, 0, 64, 2], [65, 1, 65, 2, 64, 1, 0, 0], [65, 3, 0, 0, 66, 3, 66, 4], [0, 0, 65, 4, 66, 3, 66, 4], [65, 3, 65, 4, 0, 0, 66, 4], [65, 3, 65, 4, 66, 3, 0, 0], [65, 5, 0, 0, 64, 5, 64, 6], [0, 0, 65, 6, 64, 5, 64, 6], [65, 5, 65, 6, 0, 0, 64, 6], [65, 5, 65, 6, 64, 5, 0, 0], [65, 7, 0, 0, 66, 7, 66, 8], [0, 0, 65, 8, 66, 7, 66, 8], [65, 7, 65, 8, 0, 0, 66, 8], [65, 7, 65, 8, 66, 7, 0, 0], [65, 9, 0, 0, 64, 9, 64, 10], [0, 0, 65, 10, 64, 9, 64, 10], [65, 9, 65, 10, 0, 0, 64, 10], [65, 9, 65, 10, 64, 9, 0, 0], [67, 1, 0, 0, 66, 1, 66, 2], [0, 0, 67, 2, 66, 1, 66, 2], [67, 1, 67, 2, 0, 0, 66, 2], [67, 1, 67, 2, 66, 1, 0, 0], [67, 3, 0, 0, 68, 3, 68, 4], [0, 0, 67, 4, 68, 3, 68, 4], [67, 3, 67, 4, 0, 0, 68, 4], [67, 3, 67, 4, 68, 3, 0, 0], [67, 5, 0, 0, 66, 5, 66, 6], [0, 0, 67, 6, 66, 5, 66, 6], [67, 5, 67, 6, 0, 0, 66, 6], [67, 5, 67, 6, 66, 5, 0, 0], [67, 7, 0, 0, 68, 7, 68, 8], [0, 0, 67, 8, 68, 7, 68, 8], [67, 7, 67, 8, 0, 0, 68, 8], [67, 7, 67, 8, 68, 7, 0, 0], [67, 9, 0, 0, 66, 9, 66, 10], [0, 0, 67, 10, 66, 9, 66, 10], [67, 9, 67, 10, 0, 0, 66, 10], [67, 9, 67, 10, 66, 9, 0, 0], [69, 1, 0, 0, 68, 1, 68, 2], [0, 0, 69, 2, 68, 1, 68, 2], [69, 1, 69, 2, 0, 0, 68, 2], [69, 1, 69, 2, 68, 1, 0, 0], [69, 5, 0, 0, 68, 5, 68, 6], [0, 0, 69, 6, 68, 5, 68, 6], [69, 5, 69, 6, 0, 0, 68, 6], [69, 5, 69, 6, 68, 5, 0, 0], [69, 9, 0, 0, 68, 9, 68, 10], [0, 0, 69, 10, 68, 9, 68, 10], [69, 9, 69, 10, 0, 0, 68, 10], [69, 9, 69, 10, 68, 9, 0, 0], [71, 1, 0, 0, 72, 1, 72, 2], [0, 0, 71, 2, 72, 1, 72, 2], [71, 1, 71, 2, 0, 0, 72, 2], [71, 1, 71, 2, 72, 1, 0, 0], [71, 3, 0, 0, 70, 3, 70, 4], [0, 0, 71, 4, 70, 3, 70, 4], [71, 3, 71, 4, 0, 0, 70, 4], [71, 3, 71, 4, 70, 3, 0, 0], [71, 5, 0, 0, 72, 5, 72, 6], [0, 0, 71, 6, 72, 5, 72, 6], [71, 5, 71, 6, 0, 0, 72, 6], [71, 5, 71, 6, 72, 5, 0, 0], [71, 7, 0, 0, 70, 7, 70, 8], [0, 0, 71, 8, 70, 7, 70, 8], [71, 7, 71, 8, 0, 0, 70, 8], [71, 7, 71, 8, 70, 7, 0, 0], [71, 9, 0, 0, 72, 9, 72, 10], [0, 0, 71, 10, 72, 9, 72, 10], [71, 9, 71, 10, 0, 0, 72, 10], [71, 9, 71, 10, 72, 9, 0, 0], [73, 1, 0, 0, 74, 1, 74, 2], [0, 0, 73, 2, 74, 1, 74, 2], [73, 1, 73, 2, 0, 0, 74, 2], [73, 1, 73, 2, 74, 1, 0, 0], [73, 3, 0, 0, 72, 3, 72, 4], [0, 0, 73, 4, 72, 3, 72, 4], [73, 3, 73, 4, 0, 0, 72, 4], [73, 3, 73, 4, 72, 3, 0, 0], [73, 5, 0, 0, 74, 5, 74, 6], [0, 0, 73, 6, 74, 5, 74, 6], [73, 5, 73, 6, 0, 0, 74, 6], [73, 5, 73, 6, 74, 5, 0, 0], [73, 7, 0, 0, 72, 7, 72, 8], [0, 0, 73, 8, 72, 7, 72, 8], [73, 7, 73, 8, 0, 0, 72, 8], [73, 7, 73, 8, 72, 7, 0, 0], [73, 9, 0, 0, 74, 9, 74, 10], [0, 0, 73, 10, 74, 9, 74, 10], [73, 9, 73, 10, 0, 0, 74, 10], [73, 9, 73, 10, 74, 9, 0, 0], [75, 1, 0, 0, 76, 1, 76, 2], [0, 0, 75, 2, 76, 1, 76, 2], [75, 1, 75, 2, 0, 0, 76, 2], [75, 1, 75, 2, 76, 1, 0, 0], [75, 3, 0, 0, 74, 3, 74, 4], [0, 0, 75, 4, 74, 3, 74, 4], [75, 3, 75, 4, 0, 0, 74, 4], [75, 3, 75, 4, 74, 3, 0, 0], [75, 5, 0, 0, 76, 5, 76, 6], [0, 0, 75, 6, 76, 5, 76, 6], [75, 5, 75, 6, 0, 0, 76, 6], [75, 5, 75, 6, 76, 5, 0, 0], [75, 7, 0, 0, 74, 7, 74, 8], [0, 0, 75, 8, 74, 7, 74, 8], [75, 7, 75, 8, 0, 0, 74, 8], [75, 7, 75, 8, 74, 7, 0, 0], [75, 9, 0, 0, 76, 9, 76, 10], [0, 0, 75, 10, 76, 9, 76, 10], [75, 9, 75, 10, 0, 0, 76, 10], [75, 9, 75, 10, 76, 9, 0, 0], [77, 1, 0, 0, 78, 1, 78, 2], [0, 0, 77, 2, 78, 1, 78, 2], [77, 1, 77, 2, 0, 0, 78, 2], [77, 1, 77, 2, 78, 1, 0, 0], [77, 3, 0, 0, 76, 3, 76, 4], [0, 0, 77, 4, 76, 3, 76, 4], [77, 3, 77, 4, 0, 0, 76, 4], [77, 3, 77, 4, 76, 3, 0, 0], [77, 5, 0, 0, 78, 5, 78, 6], [0, 0, 77, 6, 78, 5, 78, 6], [77, 5, 77, 6, 0, 0, 78, 6], [77, 5, 77, 6, 78, 5, 0, 0], [77, 7, 0, 0, 76, 7, 76, 8], [0, 0, 77, 8, 76, 7, 76, 8], [77, 7, 77, 8, 0, 0, 76, 8], [77, 7, 77, 8, 76, 7, 0, 0], [77, 9, 0, 0, 78, 9, 78, 10], [0, 0, 77, 10, 78, 9, 78, 10], [77, 9, 77, 10, 0, 0, 78, 10], [77, 9, 77, 10, 78, 9, 0, 0], [79, 3, 0, 0, 78, 3, 78, 4], [0, 0, 79, 4, 78, 3, 78, 4], [79, 3, 79, 4, 0, 0, 78, 4], [79, 3, 79, 4, 78, 3, 0, 0], [79, 7, 0, 0, 78, 7, 78, 8], [0, 0, 79, 8, 78, 7, 78, 8], [79, 7, 79, 8, 0, 0, 78, 8], [79, 7, 79, 8, 78, 7, 0, 0], [81, 1, 0, 0, 80, 1, 80, 2], [0, 0, 81, 2, 80, 1, 80, 2], [81, 1, 81, 2, 0, 0, 80, 2], [81, 1, 81, 2, 80, 1, 0, 0], [81, 3, 0, 0, 82, 3, 82, 4], [0, 0, 81, 4, 82, 3, 82, 4], [81, 3, 81, 4, 0, 0, 82, 4], [81, 3, 81, 4, 82, 3, 0, 0], [81, 5, 0, 0, 80, 5, 80, 6], [0, 0, 81, 6, 80, 5, 80, 6], [81, 5, 81, 6, 0, 0, 80, 6], [81, 5, 81, 6, 80, 5, 0, 0], [81, 7, 0, 0, 82, 7, 82, 8], [0, 0, 81, 8, 82, 7, 82, 8], [81, 7, 81, 8, 0, 0, 82, 8], [81, 7, 81, 8, 82, 7, 0, 0], [81, 9, 0, 0, 80, 9, 80, 10], [0, 0, 81, 10, 80, 9, 80, 10], [81, 9, 81, 10, 0, 0, 80, 10], [81, 9, 81, 10, 80, 9, 0, 0], [83, 1, 0, 0, 82, 1, 82, 2], [0, 0, 83, 2, 82, 1, 82, 2], [83, 1, 83, 2, 0, 0, 82, 2], [83, 1, 83, 2, 82, 1, 0, 0], [83, 3, 0, 0, 84, 3, 84, 4], [0, 0, 83, 4, 84, 3, 84, 4], [83, 3, 83, 4, 0, 0, 84, 4], [83, 3, 83, 4, 84, 3, 0, 0], [83, 5, 0, 0, 82, 5, 82, 6], [0, 0, 83, 6, 82, 5, 82, 6], [83, 5, 83, 6, 0, 0, 82, 6], [83, 5, 83, 6, 82, 5, 0, 0], [83, 7, 0, 0, 84, 7, 84, 8], [0, 0, 83, 8, 84, 7, 84, 8], [83, 7, 83, 8, 0, 0, 84, 8], [83, 7, 83, 8, 84, 7, 0, 0], [83, 9, 0, 0, 82, 9, 82, 10], [0, 0, 83, 10, 82, 9, 82, 10], [83, 9, 83, 10, 0, 0, 82, 10], [83, 9, 83, 10, 82, 9, 0, 0], [85, 1, 0, 0, 84, 1, 84, 2], [0, 0, 85, 2, 84, 1, 84, 2], [85, 1, 85, 2, 0, 0, 84, 2], [85, 1, 85, 2, 84, 1, 0, 0], [85, 3, 0, 0, 86, 3, 86, 4], [0, 0, 85, 4, 86, 3, 86, 4], [85, 3, 85, 4, 0, 0, 86, 4], [85, 3, 85, 4, 86, 3, 0, 0], [85, 5, 0, 0, 84, 5, 84, 6], [0, 0, 85, 6, 84, 5, 84, 6], [85, 5, 85, 6, 0, 0, 84, 6], [85, 5, 85, 6, 84, 5, 0, 0], [85, 7, 0, 0, 86, 7, 86, 8], [0, 0, 85, 8, 86, 7, 86, 8], [85, 7, 85, 8, 0, 0, 86, 8], [85, 7, 85, 8, 86, 7, 0, 0], [85, 9, 0, 0, 84, 9, 84, 10], [0, 0, 85, 10, 84, 9, 84, 10], [85, 9, 85, 10, 0, 0, 84, 10], [85, 9, 85, 10, 84, 9, 0, 0], [87, 1, 0, 0, 86, 1, 86, 2], [0, 0, 87, 2, 86, 1, 86, 2], [87, 1, 87, 2, 0, 0, 86, 2], [87, 1, 87, 2, 86, 1, 0, 0], [87, 3, 0, 0, 88, 3, 88, 4], [0, 0, 87, 4, 88, 3, 88, 4], [87, 3, 87, 4, 0, 0, 88, 4], [87, 3, 87, 4, 88, 3, 0, 0], [87, 5, 0, 0, 86, 5, 86, 6], [0, 0, 87, 6, 86, 5, 86, 6], [87, 5, 87, 6, 0, 0, 86, 6], [87, 5, 87, 6, 86, 5, 0, 0], [87, 7, 0, 0, 88, 7, 88, 8], [0, 0, 87, 8, 88, 7, 88, 8], [87, 7, 87, 8, 0, 0, 88, 8], [87, 7, 87, 8, 88, 7, 0, 0], [87, 9, 0, 0, 86, 9, 86, 10], [0, 0, 87, 10, 86, 9, 86, 10], [87, 9, 87, 10, 0, 0, 86, 10], [87, 9, 87, 10, 86, 9, 0, 0], [89, 1, 0, 0, 88, 1, 88, 2], [0, 0, 89, 2, 88, 1, 88, 2], [89, 1, 89, 2, 0, 0, 88, 2], [89, 1, 89, 2, 88, 1, 0, 0], [89, 5, 0, 0, 88, 5, 88, 6], [0, 0, 89, 6, 88, 5, 88, 6], [89, 5, 89, 6, 0, 0, 88, 6], [89, 5, 89, 6, 88, 5, 0, 0], [89, 9, 0, 0, 88, 9, 88, 10], [0, 0, 89, 10, 88, 9, 88, 10], [89, 9, 89, 10, 0, 0, 88, 10], [89, 9, 89, 10, 88, 9, 0, 0], [91, 1, 0, 0, 92, 1, 92, 2], [0, 0, 91, 2, 92, 1, 92, 2], [91, 1, 91, 2, 0, 0, 92, 2], [91, 1, 91, 2, 92, 1, 0, 0], [91, 3, 0, 0, 90, 3, 90, 4], [0, 0,

TABLE 32-continued 91, 4, 90, 3, 90, 4], [91, 3, 91, 4, 0, 0, 90, 4], [91, 3, 91, 4, 90, 3, 0, 0], [91, 5, 0, 0, 92, 5, 92, 6], [0, 0, 91, 6, 92, 5, 92, 6], [91, 5, 91, 6, 0, 0, 92, 6], [91, 5, 91, 6, 92, 5, 0, 0], [91, 7, 0, 0, 90, 7, 90, 8], [0, 0, 91, 8, 90, 7, 90, 8], [91, 7, 91, 8, 0, 0, 90, 8], [91, 7, 91, 8, 90, 7, 0, 0], [91, 9, 0, 0, 92, 9, 92, 10], [0, 0, 91, 10, 92, 9, 92, 10], [91, 9, 91, 10, 0, 0, 92, 10], [91, 9, 91, 10, 92, 9, 0, 0], [93, 1, 0, 0, 94, 1, 94, 2], [0, 0, 93, 2, 94, 1, 94, 2], [93, 1, 93, 2, 0, 0, 94, 2], [93, 1, 93, 2, 94, 1, 0, 0], [93, 3, 0, 0, 92, 3, 92, 4], [0, 0, 93, 4, 92, 3, 92, 4], [93, 3, 93, 4, 0, 0, 92, 4], [93, 3, 93, 4, 92, 3, 0, 0], [93, 5, 0, 0, 94, 5, 94, 6], [0, 0, 93, 6, 94, 5, 94, 6], [93, 5, 93, 6, 0, 0, 94, 6], [93, 5, 93, 6, 94, 5, 0, 0], [93, 7, 0, 0, 92, 7, 92, 8], [0, 0, 93, 8, 92, 7, 92, 8], [93, 7, 93, 8, 0, 0, 92, 8], [93, 7, 93, 8, 92, 7, 0, 0], [93, 9, 0, 0, 94, 9, 94, 10], [0, 0, 93, 10, 94, 9, 94, 10], [93, 9, 93, 10, 0, 0, 94, 10], [93, 9, 93, 10, 94, 9, 0, 0], [95, 1, 0, 0, 96, 1, 96, 2], [0, 0, 95, 2, 96, 1, 96, 2], [95, 1, 95, 2, 0, 0, 96, 2], [95, 1, 95, 2, 96, 1, 0, 0], [95, 3, 0, 0, 94, 3, 94, 4], [0, 0, 95, 4, 94, 3, 94, 4], [95, 3, 95, 4, 0, 0, 94, 4], [95, 3, 95, 4, 94, 3, 0, 0], [95, 5, 0, 0, 96, 5, 96, 6], [0, 0, 95, 6, 96, 5, 96, 6], [95, 5, 95, 6, 0, 0, 96, 6], [95, 5, 95, 6, 96, 5, 0, 0], [95, 7, 0, 0, 94, 7, 94, 8], [0, 0, 95, 8, 94, 7, 94, 8], [95, 7, 95, 8, 0, 0, 94, 8], [95, 7, 95, 8, 94, 7, 0, 0], [95, 9, 0, 0, 96, 9, 96, 10], [0, 0, 95, 10, 96, 9, 96, 10], [95, 9, 95, 10, 0, 0, 96, 10], [95, 9, 95, 10, 96, 9, 0, 0], [97, 1, 0, 0, 98, 1, 98, 2], [0, 0, 97, 2, 98, 1, 98, 2], [97, 1, 97, 2, 0, 0, 98, 2], [97, 1, 97, 2, 98, 1, 0, 0], [97, 3, 0, 0, 96, 3, 96, 4], [0, 0, 97, 4, 96, 3, 96, 4], [97, 3, 97, 4, 0, 0, 96, 4], [97, 3, 97, 4, 96, 3, 0, 0], [97, 5, 0, 0, 98, 5, 98, 6], [0, 0, 97, 6, 98, 5, 98, 6], [97, 5, 97, 6, 0, 0, 98, 6], [97, 5, 97, 6, 98, 5, 0, 0], [97, 7, 0, 0, 96, 7, 96, 8], [0, 0, 97, 8, 96, 7, 96, 8], [97, 7, 97, 8, 0, 0, 96, 8], [97, 7, 97, 8, 96, 7, 0, 0], [97, 9, 0, 0, 98, 9, 98, 10], [0, 0, 97, 10, 98, 9, 98, 10], [97, 9, 97, 10, 0, 0, 98, 10], [97, 9, 97, 10, 98, 9, 0, 0], [99, 3, 0, 0, 98, 3, 98, 4], [0, 0, 99, 4, 98, 3, 98, 4], [99, 3, 99, 4, 0, 0, 98, 4], [99, 3, 99, 4, 98, 3, 0, 0], [99, 7, 0, 0, 98, 7, 98, 8], [0, 0, 99, 8, 98, 7, 98, 8], [99, 7, 99, 8, 0, 0, 98, 8], [99, 7, 99, 8, 98, 7, 0, 0], [0, 2, 0, 0, 19, 2, 19, 3], [0, 0, 0, 3, 19, 2, 19, 3], [0, 2, 0, 3, 19, 2, 0, 0], [0, 6, 0, 0, 19, 6, 19, 7], [0, 0, 0, 7, 19, 6, 19, 7], [0, 6, 0, 7, 0, 0, 19, 7], [0, 6, 0, 7, 19, 6, 0, 0], [2, 2, 0, 0, 17, 2, 17, 3], [0, 0, 2, 3, 17, 2, 17, 3], [2, 2, 2, 3, 0, 0, 17, 3], [2, 2, 2, 3, 17, 2, 0, 0], [2, 6, 0, 0, 17, 6, 17, 7], [0, 0, 2, 7, 17, 6, 17, 7], [2, 6, 2, 7, 0, 0, 17, 7], [2, 6, 2, 7, 17, 6, 0, 0], [4, 2, 0, 0, 15, 2, 15, 3], [0, 0, 4, 3, 15, 2, 15, 3], [4, 2, 4, 3, 0, 0, 15, 3], [4, 2, 4, 3, 15, 2, 0, 0], [4, 6, 0, 0, 15, 6, 15, 7], [0, 0, 4, 7, 15, 6, 15, 7], [4, 6, 4, 7, 0, 0, 15, 7], [4, 6, 4, 7, 15, 6, 0, 0], [6, 2, 0, 0, 13, 2, 13, 3], [0, 0, 6, 3, 13, 2, 13, 3], [6, 2, 6, 3, 0, 0, 13, 3], [6, 2, 6, 3, 13, 2, 0, 0], [6, 6, 0, 0, 13, 6, 13, 7], [0, 0, 6, 7, 13, 6, 13, 7], [6, 6, 6, 7, 0, 0, 13, 7], [6, 6, 6, 7, 13, 6, 0, 0], [8, 2, 0, 0, 11, 2, 11, 3], [0, 0, 8, 3, 11, 2, 11, 3], [8, 2, 8, 3, 0, 0, 11, 3], [8, 2, 8, 3, 11, 2, 0, 0], [8, 6, 0, 0, 11, 6, 11, 7], [0, 0, 8, 7, 11, 6, 11, 7], [8, 6, 8, 7, 0, 0, 11, 7], [8, 6, 8, 7, 11, 6, 0, 0], [10, 2, 0, 0, 29, 2, 29, 3], [0, 0, 10, 3, 29, 2, 29, 3], [10, 2, 10, 3, 0, 0, 29, 3], [10, 2, 10, 3, 29, 2, 0, 0], [10, 4, 0, 0, 9, 4, 9, 5], [0, 0, 10, 5, 9, 4, 9, 5], [10, 4, 10, 5, 0, 0, 9, 5], [10, 4, 10, 5, 9, 4, 0, 0], [10, 6, 0, 0, 29, 6, 29, 7], [0, 0, 10, 7, 29, 6, 29, 7], [10, 6, 10, 7, 0, 0, 29, 7], [10, 6, 10, 7, 29, 6, 0, 0], [10, 8, 0, 0, 9, 8, 9, 9], [0, 0, 10, 9, 9, 8, 9, 9], [10, 8, 10, 9, 0, 0, 9, 9], [10, 8, 10, 9, 9, 8, 0, 0], [12, 2, 0, 0, 27, 2, 27, 3], [0, 0, 12, 3, 27, 2, 27, 3], [12, 2, 12, 3, 0, 0, 27, 3], [12, 2, 12, 3, 27, 2, 0, 0], [12, 4, 0, 0, 7, 4, 7, 5], [0, 0, 12, 5, 7, 4, 7, 5], [12, 4, 12, 5, 0, 0, 7, 5], [12, 4, 12, 5, 7, 4, 0, 0], [12, 6, 0, 0, 27, 6, 27, 7], [0, 0, 12, 7, 27, 6, 27, 7], [12, 6, 12, 7, 0, 0, 27, 7], [12, 6, 12, 7, 27, 6, 0, 0], [12, 8, 0, 0, 7, 8, 7, 9], [0, 0, 12, 9, 7, 8, 7, 9], [12, 8, 12, 9, 0, 0, 7, 9], [12, 8, 12, 9, 7, 8, 0, 0], [14, 2, 0, 0, 25, 2, 25, 3], [0, 0, 14, 3, 25, 2, 25, 3], [14, 2, 14, 3, 0, 0, 25, 3], [14, 2, 14, 3, 25, 2, 0, 0], [14, 4, 0, 0, 5, 4, 5, 5], [0, 0, 14, 5, 5, 4, 5, 5], [14, 4, 14, 5, 0, 0, 5, 5], [14, 4, 14, 5, 5, 4, 0, 0], [14, 6, 0, 0, 25, 6, 25, 7], [0, 0, 14, 7, 25, 6, 25, 7], [14, 6, 14, 7, 0, 0, 25, 7], [14, 6, 14, 7, 25, 6, 0, 0], [14, 8, 0, 0, 5, 8, 5, 9], [0, 0, 14, 9, 5, 8, 5, 9], [14, 8, 14, 9, 0, 0, 5, 9], [14, 8, 14, 9, 5, 8, 0, 0], [16, 2, 0, 0, 23, 2, 23, 3], [0, 0, 16, 3, 23, 2, 23, 3], [16, 2, 16, 3, 0, 0, 23, 3], [16, 2, 16, 3, 23, 2, 0, 0], [16, 4, 0, 0, 3, 4, 3, 5], [0, 0, 16, 5, 3, 4, 3, 5], [16, 4, 16, 5, 0, 0, 3, 5], [16, 4, 16, 5, 3, 4, 0, 0], [16, 6, 0, 0, 23, 6, 23, 7], [0, 0, 16, 7, 23, 6, 23, 7], [16, 6, 16, 7, 0, 0, 23, 7], [16, 6, 16, 7, 23, 6, 0, 0], [16, 8, 0, 0, 3, 8, 3, 9], [0, 0, 16, 9, 3, 8, 3, 9], [16, 8, 16, 9, 0, 0, 3, 9], [16, 8, 16, 9, 3, 8, 0, 0], [18, 2, 0, 0, 21, 2, 21, 3], [0, 0, 18, 3, 21, 2, 21, 3], [18, 2, 18, 3, 0, 0, 21, 3], [18, 2, 18, 3, 21, 2, 0, 0], [18, 4, 0, 0, 1, 4, 1, 5], [0, 0, 18, 5, 1, 4, 1, 5], [18, 4, 18, 5, 0, 0, 1, 5], [18, 4, 18, 5, 1, 4, 0, 0], [18, 6, 0, 0, 21, 6, 21, 7], [0, 0, 18, 7, 21, 6, 21, 7], [18, 6, 18, 7, 0, 0, 21, 7], [18, 6, 18, 7, 21, 6, 0, 0], [18, 8, 0, 0, 1, 8, 1, 9], [0, 0, 18, 9, 1, 8, 1, 9], [18, 8, 18, 9, 0, 0, 1, 9], [18, 8, 18, 9, 1, 8, 0, 0], [20, 2, 0, 0, 39, 2, 39, 3], [0, 0, 20, 3, 39, 2, 39, 3], [20, 2, 20, 3, 0, 0, 39, 3], [20, 2, 20, 3, 39, 2, 0, 0], [20, 4, 0, 0, 19, 4, 19, 5], [0, 0, 20, 5, 19, 4, 19, 5], [20, 4, 20, 5, 0, 0, 19, 5], [20, 4, 20, 5, 19, 4, 0, 0], [20, 6, 0, 0, 39, 6, 39, 7], [0, 0, 20, 7, 39, 6, 39, 7], [20, 6, 20, 7, 0, 0, 39, 7], [20, 6, 20, 7, 39, 6, 0, 0], [20, 8, 0, 0, 19, 8, 19, 9], [0, 0, 20, 9, 19, 8, 19, 9], [20, 8, 20, 9, 0, 0, 19, 9], [20, 8, 20, 9, 19, 8, 0, 0], [22, 2, 0, 0, 37, 2, 37, 3], [0, 0, 22, 3, 37, 2, 37, 3], [22, 2, 22, 3, 0, 0, 37, 3], [22, 2, 22, 3, 37, 2, 0, 0], [22, 4, 0, 0, 17, 4, 17, 5], [0, 0, 22, 5, 17, 4, 17, 5], [22, 4, 22, 5, 0, 0, 17, 5], [22, 4, 22, 5, 17, 4, 0, 0], [22, 6, 0, 0, 37, 6, 37, 7], [0, 0, 22, 7, 37, 6, 37, 7], [22, 6, 22, 7, 0, 0, 37, 7], [22, 6, 22, 7, 37, 6, 0, 0], [22, 8, 0, 0, 17, 8, 17, 9], [0, 0, 22, 9, 17, 8, 17, 9], [22, 8, 22, 9, 0, 0, 17, 9], [22, 8, 22, 9, 17, 8, 0, 0], [24, 2, 0, 0, 35, 2, 35, 3], [0, 0, 24, 3, 35, 2, 35, 3], [24, 2, 24, 3, 0, 0, 35, 3], [24, 2, 24, 3, 35, 2, 0, 0], [24, 4, 0, 0, 15, 4, 15, 5], [0, 0, 24, 5, 15, 4, 15, 5], [24, 4, 24, 5, 0, 0, 15, 5], [24, 4, 24, 5, 15, 4, 0, 0], [24, 6, 0, 0, 35, 6, 35, 7], [0, 0, 24, 7, 35, 6, 35, 7], [24, 6, 24, 7, 0, 0, 35, 7], [24, 6, 24, 7, 35, 6, 0, 0], [24, 8, 0, 0, 15, 8, 15, 9], [0, 0, 24, 9, 15, 8, 15, 9], [24, 8, 24, 9, 0, 0, 15, 9], [24, 8, 24, 9, 15, 8, 0, 0], [26, 2, 0, 0, 33, 2, 33, 3], [0, 0, 26, 3, 33, 2, 33, 3], [26, 2, 26, 3, 0, 0, 33, 3], [26, 2, 26, 3, 33, 2, 0, 0], [26, 4, 0, 0, 13, 4, 13, 5], [0, 0, 26, 5, 13, 4, 13, 5], [26, 4, 26, 5, 0, 0, 13, 5], [26, 4, 26, 5, 13, 4, 0, 0], [26, 6, 0, 0, 33, 6, 33, 7], [0, 0, 26, 7, 33, 6, 33, 7], [26, 6, 26, 7, 0, 0, 33, 7], [26, 6, 26, 7, 33, 6, 0, 0], [26, 8, 0, 0, 13, 8, 13, 9], [0, 0, 26, 9, 13, 8, 13, 9], [26, 8, 26, 9, 0, 0, 13, 9], [26, 8, 26, 9, 13, 8, 0, 0], [28, 2, 0, 0, 31, 2, 31, 3], [0, 0, 28, 3, 31, 2, 31, 3], [28, 2, 28, 3, 0, 0, 31, 3], [28, 2, 28, 3, 31, 2, 0, 0], [28, 4, 0, 0, 11, 4, 11, 5], [0, 0, 28, 5, 11, 4, 11, 5], [28, 4, 28, 5, 0, 0, 11, 5], [28, 4, 28, 5, 11, 4, 0, 0], [28, 6, 0, 0, 31, 6, 31, 7], [0, 0, 28, 7, 31, 6, 31, 7], [28, 6, 28, 7, 0, 0, 31, 7], [28, 6, 28, 7, 31, 6, 0, 0], [28, 8, 0, 0, 11, 8, 11, 9], [0, 0, 28, 9, 11, 8, 11, 9], [28, 8, 28, 9, 0, 0, 11, 9], [28, 8, 28, 9, 11, 8, 0, 0], [30, 2, 0, 0, 49, 2, 49, 3], [0, 0, 30, 3, 49, 2, 49, 3], [30, 2, 30, 3, 0, 0, 49, 3], [30, 2, 30, 3, 49, 2, 0, 0], [30, 4, 0, 0, 29, 4, 29, 5], [0, 0, 30, 5, 29, 4, 29, 5], [30, 4, 30, 5, 0, 0, 29, 5], [30, 4, 30, 5, 29, 4, 0, 0], [30, 6, 0, 0, 49, 6, 49, 7], [0, 0, 30, 7, 49, 6, 49, 7], [30, 6, 30, 7, 0, 0, 49, 7], [30, 6, 30, 7, 49, 6, 0, 0], [30, 8, 0, 0, 29, 8, 29, 9], [0, 0, 30, 9, 29, 8, 29, 9], [30, 8, 30, 9, 0, 0, 29, 9], [30, 8, 30, 9, 29, 8, 0, 0], [32, 2, 0, 0, 47, 2, 47, 3], [0, 0, 32, 3, 47, 2, 47, 3], [32, 2, 32, 3, 0, 0, 47, 3], [32, 2, 32, 3, 47, 2, 0, 0], [32, 4, 0, 0, 27, 4, 27, 5], [0, 0, 32, 5, 27, 4, 27, 5], [32, 4, 32, 5, 0, 0, 27, 5], [32, 4, 32, 5, 27, 4, 0, 0], [32, 6, 0, 0, 47, 6, 47, 7], [0, 0, 32, 7, 47, 6, 47, 7], [32, 6, 32, 7, 0, 0, 47, 7], [32, 6, 32, 7, 47, 6, 0, 0], [32, 8, 0, 0, 27, 8, 27, 9], [0, 0, 32, 9, 27, 8, 27, 9], [32, 8, 32, 9, 0, 0, 27, 9], [32, 8, 32, 9, 27, 8, 0, 0], [34, 2, 0, 0, 45, 2, 45, 3], [0, 0, 34, 3, 45, 2, 45, 3], [34, 2, 34, 3, 0, 0, 45, 3], [34, 2, 34, 3, 45, 2, 0, 0], [34, 4, 0, 0, 25, 4, 25, 5], [0, 0, 34, 5, 25, 4, 25, 5], [34, 4, 34, 5, 0, 0, 25, 5], [34, 4, 34, 5, 25, 4, 0, 0], [34, 6, 0, 0, 45, 6, 45, 7], [0, 0, 34, 7, 45, 6, 45, 7], [34, 6, 34, 7, 0, 0, 45, 7], [34, 6, 34, 7, 45, 6, 0, 0], [34, 8, 0, 0, 25, 8, 25, 9], [0, 0, 34, 9, 25, 8, 25, 9], [34, 8, 34, 9, 0, 0, 25, 9], [34, 8, 34, 9, 25, 8, 0, 0], [36, 2, 0, 0, 43, 2, 43, 3], [0, 0, 36, 3, 43, 2, 43, 3], [36, 2, 36, 3, 0, 0, 43, 3], [36, 2, 36, 3, 43, 2, 0, 0], [36, 4, 0, 0, 23, 4, 23, 5], [0, 0, 36, 5, 23, 4, 23, 5], [36, 4, 36, 5, 0, 0, 23, 5], [36, 4, 36, 5, 23, 4, 0, 0], [36, 6, 0, 0, 43, 6, 43, 7], [0, 0, 36, 7, 43, 6, 43, 7], [36, 6, 36, 7, 0, 0, 43, 7], [36, 6, 36, 7, 43, 6, 0, 0], [36, 8, 0, 0, 23, 8, 23, 9], [0, 0, 36, 9, 23, 8, 23, 9], [36, 8, 36, 9, 0, 0, 23, 9], [36, 8, 36, 9, 23, 8, 0, 0], [38, 2, 0, 0, 41, 2, 41, 3], [0, 0, 38, 3, 41, 2, 41, 3], [38, 2, 38, 3, 0, 0, 41, 3], [38, 2, 38, 3, 41, 2, 0, 0], [38, 4, 0, 0, 21, 4, 21, 5], [0, 0, 38, 5, 21, 4, 21, 5], [38, 4, 38, 5, 0, 0, 21, 5], [38, 4, 38, 5, 21, 4, 0, 0], [38, 6, 0, 0, 41, 6, 41, 7], [0, 0, 38, 7, 41, 6, 41, 7], [38, 6, 38, 7, 0, 0, 41, 7], [38, 6, 38, 7, 41, 6, 0, 0], [38, 8, 0, 0, 21, 8, 21, 9], [0, 0, 38, 9, 21, 8, 21, 9], [38, 8, 38, 9, 0, 0, 21, 9], [38, 8, 38, 9, 21, 8, 0, 0], [40, 2, 0, 0, 59, 2, 59, 3], [0, 0, 40, 3, 59, 2, 59, 3], [40, 2, 40, 3, 0, 0, 59, 3], [40, 2, 40, 3, 59, 2, 0, 0], [40, 4, 0, 0, 39, 4, 39, 5], [0, 0, 40, 5, 39, 4, 39, 5], [40, 4, 40, 5, 0, 0, 39, 5], [40, 4, 40, 5, 39, 4, 0, 0], [40, 6, 0, 0, 59, 6, 59, 7], [0, 0, 40, 7, 59, 6, 59, 7], [40, 6, 40, 7, 0, 0, 59, 7], [40, 6, 40, 7, 59, 6, 0, 0], [40, 8, 0, 0, 39, 8, 39, 9], [0, 0, 40, 9, 39, 8, 39, 9], [40, 8, 40, 9, 0, 0, 39, 9], [40, 8, 40, 9, 39, 8, 0, 0], [42, 2, 0, 0, 57, 2, 57, 3], [0, 0, 42, 3, 57, 2, 57, 3], [42, 2, 42, 3, 0, 0, 57, 3], [42, 2, 42, 3, 57, 2, 0, 0], [42, 4, 0, 0, 37, 4, 37, 5], [0, 0, 42, 5, 37, 4, 37, 5], [42, 4, 42, 5, 0, 0, 37, 5], [42, 4, 42, 5, 37, 4, 0, 0], [42, 6, 0, 0, 57, 6, 57, 7], [0, 0, 42, 7, 57, 6, 57, 7], [42, 6, 42, 7, 0, 0, 57, 7], [42, 6, 42, 7, 57, 6, 0, 0], [42, 8, 0, 0, 37, 8, 37, 9], [0, 0, 42, 9, 37, 8, 37, 9], [42, 8, 42, 9, 0, 0, 37, 9], [42, 8, 42, 9, 37, 8, 0, 0], [44, 2, 0, 0, 55, 2, 55, 3], [0, 0, 44, 3, 55, 2, 55, 3], [44, 2, 44, 3, 0, 0, 55, 3], [44, 2, 44, 3, 55, 2, 0, 0], [44, 4, 0, 0, 35, 4, 35, 5], [0, 0, 44, 5, 35, 4, 35, 5], [44, 4, 44, 5, 0, 0, 35, 5], [44, 4, 44, 5, 35, 4, 0, 0], [44, 6, 0, 0, 55, 6, 55, 7], [0, 0, 44, 7, 55, 6, 55, 7], [44, 6, 44, 7, 0, 0, 55, 7], [44, 6, 44, 7, 55, 6, 0, 0], [44, 8, 0, 0, 35, 8, 35, 9], [0, 0, 44, 9, 35, 8, 35, 9], [44, 8, 44, 9, 0, 0, 35, 9], [44, 8, 44, 9, 35, 8, 0, 0], [46, 2, 0, 0, 53, 2, 53, 3], [0, 0, 46, 3, 53, 2, 53, 3], [46, 2, 46, 3, 0, 0, 53, 3], [46, 2, 46, 3, 53, 2, 0, 0], [46, 4, 0, 0, 33, 4, 33, 5], [0, 0, 46, 5, 33, 4, 33, 5], [46, 4, 46, 5, 0, 0, 33, 5], [46, 4, 46, 5, 33, 4, 0, 0], [46, 6, 0, 0, 53, 6, 53, 7], [0, 0, 46, 7, 53, 6, 53, 7], [46, 6, 46, 7, 0, 0, 53, 7], [46, 6, 46, 7, 53, 6, 0, 0], [46, 8, 0, 0, 33, 8, 33, 9], [0, 0, 46, 9, 33, 8, 33, 9], [46, 8, 46, 9, 0, 0, 33, 9], TABLE 32-continued

[46, 8, 46, 9, 33, 8, 0, 0], [48, 2, 0, 0, 51, 2, 51, 3], [0, 0, 48, 3, 51, 2, 51, 3], [48, 2, 48, 3, 0, 0, 51, 3], [48, 2, 48, 3, 51, 2, 0, 0], [48, 4, 0, 0, 31, 4, 31, 5], [0, 0, 48, 5, 31, 4, 31, 5], [48, 4, 48, 5, 0, 0, 31, 5], [48, 4, 48, 5, 31, 4, 0, 0], [48, 6, 0, 0, 51, 6, 51, 7], [0, 0, 48, 7, 51, 6, 51, 7], [48, 6, 48, 7, 0, 0, 51, 7], [48, 6, 48, 7, 51, 6, 0, 0], [48, 8, 0, 0, 31, 8, 31, 9], [0, 0, 48, 9, 31, 8, 31, 9], [48, 8, 48, 9, 0, 0, 31, 9], [48, 8, 48, 9, 31, 8, 0, 0], [50, 2, 0, 0, 69, 2, 69, 3], [0, 0, 50, 3, 69, 2, 69, 3], [50, 2, 50, 3, 0, 0, 69, 3], [50, 2, 50, 3, 69, 2, 0, 0], [50, 4, 0, 0, 49, 4, 49, 5], [0, 0, 50, 5, 49, 4, 49, 5], [50, 4, 50, 5, 0, 0, 49, 5], [50, 4, 50, 5, 49, 4, 0, 0], [50, 6, 0, 0, 69, 6, 69, 7], [0, 0, 50, 7, 69, 6, 69, 7], [50, 6, 50, 7, 0, 0, 69, 7], [50, 6, 50, 7, 69, 6, 0, 0], [50, 8, 0, 0, 49, 8, 49, 9], [0, 0, 50, 9, 49, 8, 49, 9], [50, 8, 50, 9, 0, 0, 49, 9], [50, 8, 50, 9, 49, 8, 0, 0], [52, 2, 0, 0, 67, 2, 67, 3], [0, 0, 52, 3, 67, 2, 67, 3], [52, 2, 52, 3, 0, 0, 67, 3], [52, 2, 52, 3, 67, 2, 0, 0], [52, 4, 0, 0, 47, 4, 47, 5], [0, 0, 52, 5, 47, 4, 47, 5], [52, 4, 52, 5, 0, 0, 47, 5], [52, 4, 52, 5, 47, 4, 0, 0], [52, 6, 0, 0, 67, 6, 67, 7], [0, 0, 52, 7, 67, 6, 67, 7], [52, 6, 52, 7, 0, 0, 67, 7], [52, 6, 52, 7, 67, 6, 0, 0], [52, 8, 0, 0, 47, 8, 47, 9], [0, 0, 52, 9, 47, 8, 47, 9], [52, 8, 52, 9, 0, 0, 47, 9], [52, 8, 52, 9, 47, 8, 0, 0], [54, 2, 0, 0, 65, 2, 65, 3], [0, 0, 54, 3, 65, 2, 65, 3], [54, 2, 54, 3, 0, 0, 65, 3], [54, 2, 54, 3, 65, 2, 0, 0], [54, 4, 0, 0, 45, 4, 45, 5], [0, 0, 54, 5, 45, 4, 45, 5], [54, 4, 54, 5, 0, 0, 45, 5], [54, 4, 54, 5, 45, 4, 0, 0], [54, 6, 0, 0, 65, 6, 65, 7], [0, 0, 54, 7, 65, 6, 65, 7], [54, 6, 54, 7, 0, 0, 65, 7], [54, 6, 54, 7, 65, 6, 0, 0], [54, 8, 0, 0, 45, 8, 45, 9], [0, 0, 54, 9, 45, 8, 45, 9], [54, 8, 54, 9, 0, 0, 45, 9], [54, 8, 54, 9, 45, 8, 0, 0], [56, 2, 0, 0, 63, 2, 63, 3], [0, 0, 56, 3, 63, 2, 63, 3], [56, 2, 56, 3, 0, 0, 63, 3], [56, 2, 56, 3, 63, 2, 0, 0], [56, 4, 0, 0, 43, 4, 43, 5], [0, 0, 56, 5, 43, 4, 43, 5], [56, 4, 56, 5, 0, 0, 43, 5], [56, 4, 56, 5, 43, 4, 0, 0], [56, 6, 0, 0, 63, 6, 63, 7], [0, 0, 56, 7, 63, 6, 63, 7], [56, 6, 56, 7, 0, 0, 63, 7], [56, 6, 56, 7, 63, 6, 0, 0], [56, 8, 0, 0, 43, 8, 43, 9], [0, 0, 56, 9, 43, 8, 43, 9], [56, 8, 56, 9, 0, 0, 43, 9], [56, 8, 56, 9, 43, 8, 0, 0], [58, 2, 0, 0, 61, 2, 61, 3], [0, 0, 58, 3, 61, 2, 61, 3], [58, 2, 58, 3, 0, 0, 61, 3], [58, 2, 58, 3, 61, 2, 0, 0], [58, 4, 0, 0, 41, 4, 41, 5], [0, 0, 58, 5, 41, 4, 41, 5], [58, 4, 58, 5, 0, 0, 41, 5], [58, 4, 58, 5, 41, 4, 0, 0], [58, 6, 0, 0, 61, 6, 61, 7], [0, 0, 58, 7, 61, 6, 61, 7], [58, 6, 58, 7, 0, 0, 61, 7], [58, 6, 58, 7, 61, 6, 0, 0], [58, 8, 0, 0, 41, 8, 41, 9], [0, 0, 58, 9, 41, 8, 41, 9], [58, 8, 58, 9, 0, 0, 41, 9], [58, 8, 58, 9, 41, 8, 0, 0], [60, 2, 0, 0, 79, 2, 79, 3], [0, 0, 60, 3, 79, 2, 79, 3], [60, 2, 60, 3, 0, 0, 79, 3], [60, 2, 60, 3, 79, 2, 0, 0], [60, 4, 0, 0, 59, 4, 59, 5], [0, 0, 60, 5, 59, 4, 59, 5], [60, 4, 60, 5, 0, 0, 59, 5], [60, 4, 60, 5, 59, 4, 0, 0], [60, 6, 0, 0, 79, 6, 79, 7], [0, 0, 60, 7, 79, 6, 79, 7], [60, 6, 60, 7, 0, 0, 79, 7], [60, 6, 60, 7, 79, 6, 0, 0], [60, 8, 0, 0, 59, 8, 59, 9], [0, 0, 60, 9, 59, 8, 59, 9], [60, 8, 60, 9, 0, 0, 59, 9], [60, 8, 60, 9, 59, 8, 0, 0], [62, 2, 0, 0, 77, 2, 77, 3], [0, 0, 62, 3, 77, 2, 77, 3], [62, 2, 62, 3, 0, 0, 77, 3], [62, 2, 62, 3, 77, 2, 0, 0], [62, 4, 0, 0, 57, 4, 57, 5], [0, 0, 62, 5, 57, 4, 57, 5], [62, 4, 62, 5, 0, 0, 57, 5], [62, 4, 62, 5, 57, 4, 0, 0], [62, 6, 0, 0, 77, 6, 77, 7], [0, 0, 62, 7, 77, 6, 77, 7], [62, 6, 62, 7, 0, 0, 77, 7], [62, 6, 62, 7, 77, 6, 0, 0], [62, 8, 0, 0, 57, 8, 57, 9], [0, 0, 62, 9, 57, 8, 57, 9], [62, 8, 62, 9, 0, 0, 57, 9], [62, 8, 62, 9, 57, 8, 0, 0], [64, 2, 0, 0, 75, 2, 75, 3], [0, 0, 64, 3, 75, 2, 75, 3], [64, 2, 64, 3, 0, 0, 75, 3], [64, 2, 64, 3, 75, 2, 0, 0], [64, 4, 0, 0, 55, 4, 55, 5], [0, 0, 64, 5, 55, 4, 55, 5], [64, 4, 64, 5, 0, 0, 55, 5], [64, 4, 64, 5, 55, 4, 0, 0], [64, 6, 0, 0, 75, 6, 75, 7], [0, 0, 64, 7, 75, 6, 75, 7], [64, 6, 64, 7, 0, 0, 75, 7], [64, 6, 64, 7, 75, 6, 0, 0], [64, 8, 0, 0, 55, 8, 55, 9], [0, 0, 64, 9, 55, 8, 55, 9], [64, 8, 64, 9, 0, 0, 55, 9], [64, 8, 64, 9, 55, 8, 0, 0], [66, 2, 0, 0, 73, 2, 73, 3], [0, 0, 66, 3, 73, 2, 73, 3], [66, 2, 66, 3, 0, 0, 73, 3], [66, 2, 66, 3, 73, 2, 0, 0], [66, 4, 0, 0, 53, 4, 53, 5], [0, 0, 66, 5, 53, 4, 53, 5], [66, 4, 66, 5, 0, 0, 53, 5], [66, 4, 66, 5, 53, 4, 0, 0], [66, 6, 0, 0, 73, 6, 73, 7], [0, 0, 66, 7, 73, 6, 73, 7], [66, 6, 66, 7, 0, 0, 73, 7], [66, 6, 66, 7, 73, 6, 0, 0], [66, 8, 0, 0, 53, 8, 53, 9], [0, 0, 66, 9, 53, 8, 53, 9], [66, 8, 66, 9, 0, 0, 53, 9], [66, 8, 66, 9, 53, 8, 0, 0], [68, 2, 0, 0, 71, 2, 71, 3], [0, 0, 68, 3, 71, 2, 71, 3], [68, 2, 68, 3, 0, 0, 71, 3], [68, 2, 68, 3, 71, 2, 0, 0], [68, 4, 0, 0, 51, 4, 51, 5], [0, 0, 68, 5, 51, 4, 51, 5], [68, 4, 68, 5, 0, 0, 51, 5], [68, 4, 68, 5, 51, 4, 0, 0], [68, 6, 0, 0, 71, 6, 71, 7], [0, 0, 68, 7, 71, 6, 71, 7], [68, 6, 68, 7, 0, 0, 71, 7], [68, 6, 68, 7, 71, 6, 0, 0], [68, 8, 0, 0, 51, 8, 51, 9], [0, 0, 68, 9, 51, 8, 51, 9], [68, 8, 68, 9, 0, 0, 51, 9], [68, 8, 68, 9, 51, 8, 0, 0], [70, 2, 0, 0, 89, 2, 89, 3], [0, 0, 70, 3, 89, 2, 89, 3], [70, 2, 70, 3, 0, 0, 89, 3], [70, 2, 70, 3, 89, 2, 0, 0], [70, 4, 0, 0, 69, 4, 69, 5], [0, 0, 70, 5, 69, 4, 69, 5], [70, 4, 70, 5, 0, 0, 69, 5], [70, 4, 70, 5, 69, 4, 0, 0], [70, 6, 0, 0, 89, 6, 89, 7], [0, 0, 70, 7, 89, 6, 89, 7], [70, 6, 70, 7, 0, 0, 89, 7], [70, 6, 70, 7, 89, 6, 0, 0], [70, 8, 0, 0, 69, 8, 69, 9], [0, 0, 70, 9, 69, 8, 69, 9], [70, 8, 70, 9, 0, 0, 69, 9], [70, 8, 70, 9, 69, 8, 0, 0], [72, 2, 0, 0, 87, 2, 87, 3], [0, 0, 72, 3, 87, 2, 87, 3], [72, 2, 72, 3, 0, 0, 87, 3], [72, 2, 72, 3, 87, 2, 0, 0], [72, 4, 0, 0, 67, 4, 67, 5], [0, 0, 72, 5, 67, 4, 67, 5], [72, 4, 72, 5, 0, 0, 67, 5], [72, 4, 72, 5, 67, 4, 0, 0], [72, 6, 0, 0, 87, 6, 87, 7], [0, 0, 72, 7, 87, 6, 87, 7], [72, 6, 72, 7, 0, 0, 87, 7], [72, 6, 72, 7, 87, 6, 0, 0], [72, 8, 0, 0, 67, 8, 67, 9], [0, 0, 72, 9, 67, 8, 67, 9], [72, 8, 72, 9, 0, 0, 67, 9], [72, 8, 72, 9, 67, 8, 0, 0], [74, 2, 0, 0, 85, 2, 85, 3], [0, 0, 74, 3, 85, 2, 85, 3], [74, 2, 74, 3, 0, 0, 85, 3], [74, 2, 74, 3, 85, 2, 0, 0], [74, 4, 0, 0, 65, 4, 65, 5], [0, 0, 74, 5, 65, 4, 65, 5], [74, 4, 74, 5, 0, 0, 65, 5], [74, 4, 74, 5, 65, 4, 0, 0], [74, 6, 0, 0, 85, 6, 85, 7], [0, 0, 74, 7, 85, 6, 85, 7], [74, 6, 74, 7, 0, 0, 85, 7], [74, 6, 74, 7, 85, 6, 0, 0], [74, 8, 0, 0, 65, 8, 65, 9], [0, 0, 74, 9, 65, 8, 65, 9], [74, 8, 74, 9, 0, 0, 65, 9], [74, 8, 74, 9, 65, 8, 0, 0], [76, 2, 0, 0, 83, 2, 83, 3], [0, 0, 76, 3, 83, 2, 83, 3], [76, 2, 76, 3, 0, 0, 83, 3], [76, 2, 76, 3, 83, 2, 0, 0], [76, 4, 0, 0, 63, 4, 63, 5], [0, 0, 76, 5, 63, 4, 63, 5], [76, 4, 76, 5, 0, 0, 63, 5], [76, 4, 76, 5, 63, 4, 0, 0], [76, 6, 0, 0, 83, 6, 83, 7], [0, 0, 76, 7, 83, 6, 83, 7], [76, 6, 76, 7, 0, 0, 83, 7], [76, 6, 76, 7, 83, 6, 0, 0], [76, 8, 0, 0, 63, 8, 63, 9], [0, 0, 76, 9, 63, 8, 63, 9], [76, 8, 76, 9, 0, 0, 63, 9], [76, 8, 76, 9, 63, 8, 0, 0], [78, 2, 0, 0, 81, 2, 81, 3], [0, 0, 78, 3, 81, 2, 81, 3], [78, 2, 78, 3, 0, 0, 81, 3], [78, 2, 78, 3, 81, 2, 0, 0], [78, 4, 0, 0, 61, 4, 61, 5], [0, 0, 78, 5, 61, 4, 61, 5], [78, 4, 78, 5, 0, 0, 61, 5], [78, 4, 78, 5, 61, 4, 0, 0], [78, 6, 0, 0, 81, 6, 81, 7], [0, 0, 78, 7, 81, 6, 81, 7], [78, 6, 78, 7, 0, 0, 81, 7], [78, 6, 78, 7, 81, 6, 0, 0], [78, 8, 0, 0, 61, 8, 61, 9], [0, 0, 78, 9, 61, 8, 61, 9], [78, 8, 78, 9, 0, 0, 61, 9], [78, 8, 78, 9, 61, 8, 0, 0], [80, 2, 0, 0, 99, 2, 99, 3], [0, 0, 80, 3, 99, 2, 99, 3], [80, 2, 80, 3, 0, 0, 99, 3], [80, 2, 80, 3, 99, 2, 0, 0], [80, 4, 0, 0, 79, 4, 79, 5], [0, 0, 80, 5, 79, 4, 79, 5], [80, 4, 80, 5, 0, 0, 79, 5], [80, 4, 80, 5, 79, 4, 0, 0], [80, 6, 0, 0, 99, 6, 99, 7], [0, 0, 80, 7, 99, 6, 99, 7], [80, 6, 80, 7, 0, 0, 99, 7], [80, 6, 80, 7, 99, 6, 0, 0], [80, 8, 0, 0, 79, 8, 79, 9], [0, 0, 80, 9, 79, 8, 79, 9], [80, 8, 80, 9, 0, 0, 79, 9], [80, 8, 80, 9, 79, 8, 0, 0], [82, 2, 0, 0, 97, 2, 97, 3], [0, 0, 82, 3, 97, 2, 97, 3], [82, 2, 82, 3, 0, 0, 97, 3], [82, 2, 82, 3, 97, 2, 0, 0], [82, 4, 0, 0, 77, 4, 77, 5], [0, 0, 82, 5, 77, 4, 77, 5], [82, 4, 82, 5, 0, 0, 77, 5], [82, 4, 82, 5, 77, 4, 0, 0], [82, 6, 0, 0, 97, 6, 97, 7], [0, 0, 82, 7, 97, 6, 97, 7], [82, 6, 82, 7, 0, 0, 97, 7], [82, 6, 82, 7, 97, 6, 0, 0], [82, 8, 0, 0, 77, 8, 77, 9], [0, 0, 82, 9, 77, 8, 77, 9], [82, 8, 82, 9, 0, 0, 77, 9], [82, 8, 82, 9, 77, 8, 0, 0], [84, 2, 0, 0, 95, 2, 95, 3], [0, 0, 84, 3, 95, 2, 95, 3], [84, 2, 84, 3, 0, 0, 95, 3], [84, 2, 84, 3, 95, 2, 0, 0], [84, 4, 0, 0, 75, 4, 75, 5], [0, 0, 84, 5, 75, 4, 75, 5], [84, 4, 84, 5, 0, 0, 75, 5], [84, 4, 84, 5, 75, 4, 0, 0], [84, 6, 0, 0, 95, 6, 95, 7], [0, 0, 84, 7, 95, 6, 95, 7], [84, 6, 84, 7, 0, 0, 95, 7], [84, 6, 84, 7, 95, 6, 0, 0], [84, 8, 0, 0, 75, 8, 75, 9], [0, 0, 84, 9, 75, 8, 75, 9], [84, 8, 84, 9, 0, 0, 75, 9], [84, 8, 84, 9, 75, 8, 0, 0], [86, 2, 0, 0, 93, 2, 93, 3], [0, 0, 86, 3, 93, 2, 93, 3], [86, 2, 86, 3, 0, 0, 93, 3], [86, 2, 86, 3, 93, 2, 0, 0], [86, 4, 0, 0, 73, 4, 73, 5], [0, 0, 86, 5, 73, 4, 73, 5], [86, 4, 86, 5, 0, 0, 73, 5], [86, 4, 86, 5, 73, 4, 0, 0], [86, 6, 0, 0, 93, 6, 93, 7], [0, 0, 86, 7, 93, 6, 93, 7], [86, 6, 86, 7, 0, 0, 93, 7], [86, 6, 86, 7, 93, 6, 0, 0], [86, 8, 0, 0, 73, 8, 73, 9], [0, 0, 86, 9, 73, 8, 73, 9], [86, 8, 86, 9, 0, 0, 73, 9], [86, 8, 86, 9, 73, 8, 0, 0], [88, 2, 0, 0, 91, 2, 91, 3], [0, 0, 88, 3, 91, 2, 91, 3], [88, 2, 88, 3, 0, 0, 91, 3], [88, 2, 88, 3, 91, 2, 0, 0], [88, 4, 0, 0, 71, 4, 71, 5], [0, 0, 88, 5, 71, 4, 71, 5], [88, 4, 88, 5, 0, 0, 71, 5], [88, 4, 88, 5, 71, 4, 0, 0], [88, 6, 0, 0, 91, 6, 91, 7], [0, 0, 88, 7, 91, 6, 91, 7], [88, 6, 88, 7, 0, 0, 91, 7], [88, 6, 88, 7, 91, 6, 0, 0], [88, 8, 0, 0, 71, 8, 71, 9], [0, 0, 88, 9, 71, 8, 71, 9], [88, 8, 88, 9, 0, 0, 71, 9], [88, 8, 88, 9, 71, 8, 0, 0], [90, 4, 0, 0, 89, 4, 89, 5], [0, 0, 90, 5, 89, 4, 89, 5], [90, 4, 90, 5, 0, 0, 89, 5], [90, 4, 90, 5, 89, 4, 0, 0], [90, 8, 0, 0, 89, 8, 89, 9], [0, 0, 90, 9, 89, 8, 89, 9], [90, 8, 90, 9, 0, 0, 89, 9], [90, 8, 90, 9, 89, 8, 0, 0], [92, 4, 0, 0, 87, 4, 87, 5], [0, 0, 92, 5, 87, 4, 87, 5], [92, 4, 92, 5, 0, 0, 87, 5], [92, 4, 92, 5, 87, 4, 0, 0], [92, 8, 0, 0, 87, 8, 87, 9], [0, 0, 92, 9, 87, 8, 87, 9], [92, 8, 92, 9, 0, 0, 87, 9], [92, 8, 92, 9, 87, 8, 0, 0], [94, 4, 0, 0, 85, 4, 85, 5], [0, 0, 94, 5, 85, 4, 85, 5], [94, 4, 94, 5, 0, 0, 85, 5], [94, 4, 94, 5, 85, 4, 0, 0], [94, 8, 0, 0, 85, 8, 85, 9], [0, 0, 94, 9, 85, 8, 85, 9], [94, 8, 94, 9, 0, 0, 85, 9], [94, 8, 94, 9, 85, 8, 0, 0], [96, 4, 0, 0, 83, 4, 83, 5], [0, 0, 96, 5, 83, 4, 83, 5], [96, 4, 96, 5, 0, 0, 83, 5], [96, 4, 96, 5, 83, 4, 0, 0], [96, 8, 0, 0, 83, 8, 83, 9], [0, 0, 96, 9, 83, 8, 83, 9], [96, 8, 96, 9, 0, 0, 83, 9], [96, 8, 96, 9, 83, 8, 0, 0], [98, 4, 0, 0, 81, 4, 81, 5], [0, 0, 98, 5, 81, 4, 81, 5], [98, 4, 98, 5, 0, 0, 81, 5], [98, 4, 98, 5, 81, 4, 0, 0], [98, 8, 0, 0, 81, 8, 81, 9], [0, 0, 98, 9, 81, 8, 81, 9], [98, 8, 98, 9, 0, 0, 81, 9], [98, 8, 98, 9, 81, 8, 0, 0], [1, 1, 1, 2, 0, 1, 0, 2, 0, 3, 0, 4], [1, 5, 1, 6, 0, 5, 0, 6, 0, 7, 0, 8], [1, 3, 1, 4, 1, 1, 1, 2, 0, 1, 0, 2], [3, 1, 1, 3, 2, 2, 1, 2, 2, 2, 3, 2, 4], [1, 5, 1, 6, 1, 3, 1, 4, 2, 3, 2, 4], [1, 7, 1, 8, 1, 5, 1, 6, 0, 5, 0, 6], [3, 5, 3, 6, 2, 5, 2, 6, 2, 7, 2, 8], [1, 9, 1, 10, 1, 7, 1, 8, 2, 7, 2, 8], [3, 3, 3, 4, 3, 1, 3, 2, 2, 1, 2, 2], [5, 1, 5, 2, 4, 1, 4, 2, 4, 3, 4, 4], [1, 3, 1, 4, 2, 3, 2, 4, 2, 5, 2, 6], [3, 7, 3, 8, 3, 5, 3, 6, 3, 3, 3, 4, 4, 4], [3, 7, 3, 8, 3, 5, 3, 6, 5, 2, 5, 2, 6], [5, 5, 5, 6, 4, 5, 4, 6, 4, 7, 4, 8], [1, 7, 1, 8, 2, 7, 2, 8, 2, 9, 2, 10], [3, 9, 3, 10, 3, 7, 3, 8, 4, 7, 4, 8], [5, 3, 5, 4, 5, 1, 5, 2, 4, 1, 4, 2], [7, 1, 7, 2, 6, 1, 6, 2, 6, 3, 6, 4], [3, 3, 3, 4, 4, 3, 4, 4, 4, 5, 4, 6], [5, 5, 5, 6, 6, 5, 3, 5, 4, 6, 3, 6, 4], [5, 7, 5, 8, 5, 5, 5, 6, 4, 5, 4, 6], [7, 5, 7, 6, 6, 5, 6, 6, 6, 7, 6, 8], [3, 7, 3, 8, 4, 7, 4, 8, 4, 9, 4, 10], [5, 9, 5, 10, 5, 7, 5, 8, 6, 7, 6, 8], [7, 3, 7, 4, 7, 1, 7, 2, 6, 1, 6, 2], [9, 1, 9, 2, 8, 1, 8, 2, 8, 3, 8, 4], [5, 3, 5, 4, 6, 3, 6, 4, 6, 5, 6, 6], [7, 5, 7, 6, 7, 3, 7, 4, 8, 3, 8, 4], [7, 7, 7, 8, 7, 5, 7, 6, 6, 5, 6, 6], [9, 5, 9, 6, 8, 5, 8, 6, 8, 7, 8, 8], [5, 7, 5, 8, 6, 7, 8, 6, 8, 7, 8, 8], [5, 7, 5, 8, 6, 7, 6, 8, 6, 9, 6, 10], [7, 9, 7, 10, 7, 7, 7, 8, 8, 7, 8, 8], [9, 3, 9, 4, 9, 1, 9, 2, 8, 1, 8, 2], [7, 3, 7, 4, 8, 3, 8, 4, 8, 5, 8, 6], [9, 7, 9, 8, 9,

TABLE 32-continued 5, 9, 6, 8, 5, 8, 6], [7, 7, 7, 8, 8, 7, 8, 8, 8, 9, 8, 10], [11, 3, 11, 4, 10, 3, 10, 4, 10, 5, 10, 6], [11, 7, 11, 8, 10, 7, 10, 8, 10, 9, 10, 10], [11, 3, 11, 4, 11, 1, 11, 2, 12, 1, 12, 2], [11, 5, 11, 6, 11, 3, 11, 4, 10, 3, 10, 4], [13, 3, 13, 4, 12, 3, 12, 4, 12, 5, 12, 6], [11, 7, 11, 8, 11, 5, 11, 6, 12, 5, 12, 6], [11, 9, 11, 10, 11, 7, 11, 8, 10, 7, 10, 8], [13, 7, 13, 8, 12, 7, 12, 8, 12, 9, 12, 10], [11, 1, 11, 2, 12, 1, 12, 2, 12, 3, 12, 4], [13, 3, 13, 4, 13, 1, 13, 2, 14, 1, 14, 2], [13, 5, 13, 6, 13, 3, 13, 4, 12, 3, 12, 4], [15, 3, 15, 4, 14, 3, 14, 4, 14, 5, 14, 6], [11, 5, 11, 6, 12, 5, 12, 6, 12, 7, 12, 8], [13, 7, 13, 8, 13, 5, 13, 6, 14, 5, 14, 6], [13, 9, 13, 10, 13, 7, 13, 8, 12, 7, 12, 8], [15, 7, 15, 8, 14, 7, 14, 8, 14, 9, 14, 10], [13, 1, 13, 2, 14, 1, 14, 2, 14, 3, 14, 4], [15, 3, 15, 4, 15, 1, 15, 2, 16, 1, 16, 2], [15, 5, 15, 6, 15, 3, 15, 4, 14, 3, 14, 4], [17, 3, 17, 4, 16, 3, 16, 4, 16, 5, 16, 6], [13, 5, 13, 6, 14, 5, 14, 6, 14, 7, 14, 8], [15, 7, 15, 8, 15, 5, 15, 6, 16, 5, 16, 6], [15, 9, 15, 10, 15, 7, 15, 8, 14, 7, 14, 8], [17, 7, 17, 8, 16, 7, 16, 8, 16, 9, 16, 10], [15, 1, 15, 2, 16, 1, 16, 2, 16, 3, 16, 4], [17, 3, 17, 4, 17, 1, 17, 2, 18, 1, 18, 2], [17, 5, 17, 6, 17, 3, 17, 4, 16, 3, 16, 4], [19, 3, 19, 4, 18, 3, 18, 4, 18, 5, 18, 6], [15, 5, 15, 6, 16, 5, 16, 6, 16, 7, 16, 8], [17, 7, 17, 8, 17, 5, 17, 6, 18, 5, 18, 6], [17, 9, 17, 10, 17, 7, 17, 8, 16, 7, 16, 8], [19, 7, 19, 8, 18, 7, 18, 8, 18, 9, 18, 10], [17, 1, 17, 2, 18, 1, 18, 2, 18, 3, 18, 4], [19, 5, 19, 6, 19, 3, 19, 4, 18, 3, 18, 4], [17, 5, 17, 6, 18, 5, 18, 6, 18, 7, 18, 8], [19, 9, 19, 10, 19, 7, 19, 8, 18, 7, 18, 8], [21, 1, 21, 2, 20, 1, 20, 2, 20, 3, 20, 4], [21, 5, 21, 6, 20, 5, 20, 6, 20, 7, 20, 8], [21, 3, 21, 4, 21, 1, 21, 2, 20, 1, 20, 2], [23, 1, 23, 2, 22, 1, 22, 2, 22, 3, 22, 4], [21, 5, 21, 6, 21, 3, 21, 4, 22, 3, 22, 4], [21, 7, 21, 8, 21, 5, 21, 6, 20, 5, 20, 6], [23, 5, 23, 6, 22, 5, 22, 6, 22, 7, 22, 8], [21, 9, 21, 10, 21, 7, 21, 8, 22, 7, 22, 8], [23, 3, 23, 4, 23, 1, 23, 2, 22, 1, 22, 2], [25, 1, 25, 2, 24, 1, 24, 2, 24, 3, 24, 4], [21, 3, 21, 4, 22, 3, 22, 4, 22, 5, 22, 6], [23, 5, 23, 6, 23, 3, 23, 4, 23, 3, 24, 4], [23, 7, 23, 8, 23, 5, 23, 6, 22, 5, 22, 6], [25, 5, 25, 6, 24, 5, 24, 6, 24, 7, 24, 8], [21, 7, 21, 8, 22, 7, 22, 8, 22, 9, 22, 10], [23, 9, 23, 10, 23, 7, 23, 8, 24, 7, 24, 8], [25, 3, 25, 4, 25, 1, 25, 2, 24, 1, 24, 2], [27, 1, 27, 2, 26, 1, 26, 2, 26, 3, 26, 4], [23, 3, 23, 4, 24, 3, 24, 4, 24, 5, 24, 6], [25, 5, 25, 6, 25, 3, 25, 4, 26, 3, 26, 4], [25, 7, 25, 8, 25, 5, 25, 6, 24, 5, 24, 6], [27, 5, 27, 6, 26, 5, 26, 6, 26, 7, 26, 8], [23, 7, 23, 8, 24, 7, 24, 8, 24, 9, 24, 10], [25, 9, 25, 10, 25, 7, 25, 8, 26, 7, 26, 8], [27, 3, 27, 4, 27, 1, 27, 2, 26, 1, 26, 2], [29, 1, 29, 2, 28, 1, 28, 2, 28, 3, 28, 4], [25, 3, 25, 4, 26, 3, 26, 4, 26, 5, 26, 6], [27, 5, 27, 6, 27, 3, 27, 4, 28, 3, 28, 4], [27, 7, 27, 8, 27, 5, 27, 6, 26, 5, 26, 6], [29, 5, 29, 6, 28, 5, 28, 6, 28, 7, 28, 8], [25, 7, 25, 8, 26, 7, 26, 8, 26, 9, 26, 10], [27, 9, 27, 10, 27, 7, 27, 8, 28, 7, 28, 8], [29, 3, 29, 4, 29, 1, 29, 2, 28, 1, 28, 2], [27, 3, 27, 4, 28, 3, 28, 4, 28, 5, 28, 6], [29, 7, 29, 8, 29, 5, 29, 6, 28, 5, 28, 6], [27, 7, 27, 8, 28, 7, 28, 8, 28, 9, 28, 10], [31, 3, 31, 4, 30, 3, 30, 4, 30, 5, 30, 6], [31, 7, 31, 8, 30, 7, 30, 8, 30, 9, 30, 10], [31, 3, 31, 4, 31, 1, 31, 2, 32, 1, 32, 2], [31, 5, 31, 6, 31, 3, 31, 4, 30, 3, 30, 4], [33, 3, 33, 4, 32, 3, 32, 4, 32, 5, 32, 6], [31, 7, 31, 8, 31, 5, 31, 6, 32, 5, 32, 6], [31, 9, 31, 10, 31, 7, 31, 8, 30, 7, 30, 8], [33, 7, 33, 8, 32, 7, 32, 8, 32, 9, 32, 10], [31, 1, 31, 2, 32, 1, 32, 2, 32, 3, 32, 4], [33, 3, 33, 4, 33, 1, 33, 2, 34, 1, 34, 2], [33, 5, 33, 6, 33, 3, 33, 4, 32, 3, 32, 4], [35, 3, 35, 4, 34, 3, 34, 4, 34, 5, 34, 6], [31, 5, 31, 6, 32, 5, 32, 6, 32, 7, 32, 8], [33, 7, 33, 8, 33, 5, 33, 6, 34, 5, 34, 6], [33, 9, 33, 10, 33, 7, 33, 8, 32, 7, 32, 8], [35, 7, 35, 8, 34, 7, 34, 8, 34, 9, 34, 10], [33, 1, 33, 2, 34, 1, 34, 2, 34, 3, 34, 4], [35, 3, 35, 4, 35, 1, 35, 2, 36, 1, 36, 2], [35, 5, 35, 6, 35, 3, 35, 4, 34, 3, 34, 4], [37, 3, 37, 4, 36, 3, 36, 4, 36, 5, 36, 6], [33, 5, 33, 6, 34, 5, 34, 6, 34, 7, 34, 8], [35, 7, 35, 8, 35, 5, 35, 6, 36, 5, 36, 6], [35, 9, 35, 10, 35, 7, 35, 8, 34, 7, 34, 8], [37, 7, 37, 8, 36, 7, 36, 8, 36, 9, 36, 10], [35, 1, 35, 2, 36, 1, 36, 2, 36, 3, 36, 4], [37, 3, 37, 4, 37, 1, 37, 2, 38, 1, 38, 2], [37, 5, 37, 6, 37, 3, 37, 4, 36, 3, 36, 4], [39, 3, 39, 4, 38, 3, 38, 4, 38, 5, 38, 6], [35, 5, 35, 6, 36, 5, 36, 6, 36, 7, 36, 8], [37, 7, 37, 8, 37, 5, 37, 6, 38, 5, 38, 6], [37, 9, 37, 10, 37, 7, 37, 8, 36, 7, 36, 8], [39, 7, 39, 8, 38, 7, 38, 8, 38, 9, 38, 10], [37, 1, 37, 2, 38, 1, 38, 2, 38, 3, 38, 4], [39, 5, 39, 6, 39, 3, 39, 4, 38, 3, 38, 4], [37, 5, 37, 6, 38, 5, 38, 6, 38, 7, 38, 8], [39, 9, 39, 10, 39, 7, 39, 8, 38, 7, 38, 8], [41, 1, 41, 2, 40, 1, 40, 2, 40, 3, 40, 4], [41, 5, 41, 6, 40, 5, 40, 6, 40, 7, 40, 8], [41, 3, 41, 4, 41, 1, 41, 2, 40, 1, 40, 2], [43, 1, 43, 2, 42, 1, 42, 2, 42, 3, 42, 4], [41, 5, 41, 6, 41, 3, 41, 4, 42, 3, 42, 4], [41, 7, 41, 8, 41, 5, 41, 6, 40, 5, 40, 6], [43, 5, 43, 6, 42, 5, 42, 6, 42, 7, 42, 8], [41, 9, 41, 10, 41, 7, 41, 8, 42, 7, 42, 8], [43, 3, 43, 4, 43, 1, 43, 2, 42, 1, 42, 2], [45, 1, 45, 2, 44, 1, 44, 2, 44, 3, 44, 4], [41, 3, 41, 4, 42, 3, 42, 4, 42, 5, 42, 6], [43, 5, 43, 6, 43, 3, 43, 4, 44, 3, 44, 4], [43, 7, 43, 8, 43, 5, 43, 6, 42, 5, 42, 6], [45, 5, 45, 6, 44, 5, 44, 6, 44, 7, 44, 8], [41, 7, 41, 8, 42, 7, 42, 8, 42, 9, 42, 10], [43, 9, 43, 10, 43, 7, 43, 8, 44, 7, 44, 8], [45, 3, 45, 4, 45, 1, 45, 2, 44, 1, 44, 2], [47, 1, 47, 2, 46, 1, 46, 2, 46, 3, 46, 4], [43, 3, 43, 4, 44, 3, 44, 4, 44, 5, 44, 6], [45, 5, 45, 6, 45, 3, 45, 4, 46, 3, 46, 4], [45, 7, 45, 8, 45, 5, 45, 6, 44, 5, 44, 6], [47, 5, 47, 6, 46, 5, 46, 6, 46, 7, 46, 8], [43, 7, 43, 8, 44, 7, 44, 8, 44, 9, 44, 10], [45, 9, 45, 10, 45, 7, 45, 8, 46, 7, 46, 8], [47, 3, 47, 4, 47, 1, 47, 2, 46, 1, 46, 2], [49, 1, 49, 2, 48, 1, 48, 2, 48, 3, 48, 4], [45, 3, 45, 4, 46, 3, 46, 4, 46, 5, 46, 6], [47, 5, 47, 6, 47, 3, 47, 4, 48, 3, 48, 4], [47, 7, 47, 8, 47, 5, 47, 6, 46, 5, 46, 6], [49, 5, 49, 6, 48, 5, 48, 6, 48, 7, 48, 8], [45, 7, 45, 8, 46, 7, 46, 8, 46, 9, 46, 10], [47, 9, 47, 10, 47, 7, 47, 8, 48, 7, 48, 8], [49, 3, 49, 4, 49, 1, 49, 2, 48, 1, 48, 2], [47, 3, 47, 4, 48, 3, 48, 4, 48, 5, 48, 6], [49, 7, 49, 8, 49, 5, 49, 6, 48, 5, 48, 6], [47, 7, 47, 8, 48, 7, 48, 8, 48, 9, 48, 10], [51, 3, 51, 4, 50, 3, 50, 4, 50, 5, 50, 6], [51, 7, 51, 8, 50, 7, 50, 8, 50, 9, 50, 10], [51, 3, 51, 4, 51, 1, 51, 2, 52, 1, 52, 2], [51, 5, 51, 6, 51, 3, 51, 4, 50, 3, 50, 4], [53, 3, 53, 4, 52, 3, 52, 4, 52, 5, 52, 6], [51, 7, 51, 8, 51, 5, 51, 6, 52, 5, 52, 6], [51, 9, 51, 10, 51, 7, 51, 8, 50, 7, 50, 8], [53, 7, 53, 8, 52, 7, 52, 8, 52, 9, 52, 10], [51, 1, 51, 2, 52, 1, 52, 2, 52, 3, 52, 4], [53, 3, 53, 4, 53, 1, 53, 2, 54, 1, 54, 2], [53, 5, 53, 6, 53, 3, 53, 4, 52, 3, 52, 4], [55, 3, 55, 4, 54, 3, 54, 4, 54, 5, 54, 6], [51, 5, 51, 6, 52, 5, 52, 6, 52, 7, 52, 8], [53, 7, 53, 8, 53, 5, 53, 6, 54, 5, 54, 6], [53, 9, 53, 10, 53, 7, 53, 8, 52, 7, 52, 8], [55, 7, 55, 8, 54, 7, 54, 8, 54, 9, 54, 10], [53, 1, 53, 2, 54, 1, 54, 2, 54, 3, 54, 4], [55, 3, 55, 4, 55, 1, 55, 2, 56, 1, 56, 2], [55, 5, 55, 6, 55, 3, 55, 4, 54, 3, 54, 4], [57, 3, 57, 4, 56, 3, 56, 4, 56, 5, 56, 6], [53, 5, 53, 6, 54, 5, 54, 6, 54, 7, 54, 8], [55, 7, 55, 8, 55, 5, 55, 6, 56, 5, 56, 6], [55, 9, 55, 10, 55, 7, 55, 8, 56, 7, 56, 8], [57, 7, 57, 8, 56, 7, 56, 8, 56, 9, 56, 10], [55, 1, 55, 2, 56, 1, 56, 2, 56, 3, 56, 4], [57, 3, 57, 4, 57, 1, 57, 2, 58, 1, 58, 2], [57, 5, 57, 6, 57, 3, 57, 4, 56, 3, 56, 4], [59, 3, 59, 4, 58, 3, 58, 4, 58, 5, 58, 6], [55, 5, 55, 6, 56, 5, 56, 6, 56, 7, 56, 8], [57, 7, 57, 8, 57, 5, 57, 6, 58, 5, 58, 6], [57, 9, 57, 10, 57, 7, 57, 8, 56, 7, 56, 8], [59, 7, 59, 8, 58, 7, 58, 8, 58, 9, 58, 10], [57, 1, 57, 2, 58, 1, 58, 2, 58, 3, 58, 4], [59, 5, 59, 6, 59, 3, 59, 4, 58, 3, 58, 4], [57, 5, 57, 6, 58, 5, 58, 6, 58, 7, 58, 8], [59, 9, 59, 10, 59, 7, 59, 8, 58, 7, 58, 8], [61, 1, 61, 2, 60, 1, 60, 2, 60, 3, 60, 4], [61, 5, 61, 6, 60, 5, 60, 6, 60, 7, 60, 8], [61, 3, 61, 4, 61, 1, 61, 2, 60, 1, 60, 2], [63, 1, 63, 2, 62, 1, 62, 2, 62, 3, 62, 4], [61, 5, 61, 6, 61, 3, 61, 4, 62, 3, 62, 4], [61, 7, 61, 8, 61, 5, 61, 6, 60, 5, 60, 6], [63, 5, 63, 6, 62, 5, 62, 6, 62, 7, 62, 8], [61, 9, 61, 10, 61, 7, 61, 8, 62, 7, 62, 8], [63, 3, 63, 4, 63, 1, 63, 2, 62, 1, 62, 2], [65, 1, 65, 2, 64, 1, 64, 2, 64, 3, 64, 4], [61, 3, 61, 4, 62, 3, 62, 4, 62, 5, 62, 6], [63, 5, 63, 6, 63, 3, 63, 4, 64, 3, 64, 4], [63, 7, 63, 8, 63, 5, 63, 6, 62, 5, 62, 6], [65, 5, 65, 6, 64, 5, 64, 6, 64, 7, 64, 8], [61, 7, 61, 8, 62, 7, 62, 8, 62, 9, 62, 10], [63, 9, 63, 10, 63, 7, 63, 8, 64, 7, 64, 8], [65, 3, 65, 4, 65, 1, 65, 2, 64, 1, 64, 2], [67, 1, 67, 2, 66, 1, 66, 2, 66, 3, 66, 4], [63, 3, 63, 4, 64, 3, 64, 4, 64, 5, 64, 6], [65, 5, 65, 6, 65, 3, 65, 4, 66, 3, 66, 4], [65, 7, 65, 8, 65, 5, 65, 6, 64, 5, 64, 6], [67, 5, 67, 6, 66, 5, 66, 6, 66, 7, 66, 8], [63, 7, 63, 8, 64, 7, 64, 8, 64, 9, 64, 10], [65, 9, 65, 10, 65, 7, 65, 8, 66, 7, 66, 8], [67, 3, 67, 4, 67, 1, 67, 2, 66, 1, 66, 2], [69, 1, 69, 2, 68, 1, 68, 2, 68, 3, 68, 4], [65, 3, 65, 4, 66, 3, 66, 4, 66, 5, 66, 6], [67, 5, 67, 6, 67, 3, 67, 4, 68, 3, 68, 4], [67, 7, 67, 8, 67, 5, 67, 6, 66, 5, 66, 6], [69, 5, 69, 6, 68, 5, 68, 6, 68, 7, 68, 8], [65, 7, 65, 8, 66, 7, 66, 8, 66, 9, 66, 10], [67, 9, 67, 10, 67, 7, 67, 8, 68, 7, 68, 8], [69, 3, 69, 4, 69, 1, 69, 2, 68, 1, 68, 2], [67, 3, 67, 4, 68, 3, 68, 4, 68, 5, 68, 6], [69, 7, 69, 8, 69, 5, 69, 6, 68, 5, 68, 6], [67, 7, 67, 8, 68, 7, 68, 8, 68, 9, 68, 10], [71, 3, 71, 4, 70, 3, 70, 4, 70, 5, 70, 6], [71, 7, 71, 8, 70, 7, 70, 8, 70, 9, 70, 10], [71, 3, 71, 4, 71, 1, 71, 2, 72, 1, 72, 2], [71, 5, 71, 6, 71, 3, 71, 4, 70, 3, 70, 4], [73, 3, 73, 4, 72, 3, 72, 4, 72, 5, 72, 6], [71, 7, 71, 8, 71, 5, 71, 6, 72, 5, 72, 6], [71, 9, 71, 10, 71, 7, 71, 8, 70, 7, 70, 8], [73, 7, 73, 8, 72, 7, 72, 8, 72, 9, 72, 10], [71, 1, 71, 2, 72, 1, 72, 2, 72, 3, 72, 4], [73, 3, 73, 4, 73, 1, 73, 2, 74, 1, 74, 2], [73, 5, 73, 6, 73, 3, 73, 4, 72, 3, 72, 4], [75, 3, 75, 4, 74, 3, 74, 4, 74, 5, 74, 6], [71, 5, 71, 6, 72, 5, 72, 6, 72, 7, 72, 8], [73, 7, 73, 8, 73, 5, 73, 6, 74, 5, 74, 6], [73, 9, 73, 10, 73, 7, 73, 8, 72, 7, 72, 8], [75, 7, 75, 8, 74, 7, 74, 8, 74, 9, 74, 10], [73, 1, 73, 2, 74, 1, 74, 2, 74, 3, 74, 4], [75, 3, 75, 4, 75, 1, 75, 2, 76, 1, 76, 2], [75, 5, 75, 6, 75, 3, 75, 4, 74, 3, 74, 4], [77, 3, 77, 4, 76, 3, 76, 4, 76, 5, 76, 6], [73, 5, 73, 6, 74, 5, 74, 6, 74, 7, 74, 8], [75, 7, 75, 8, 75, 5, 75, 6, 76, 5, 76, 6], [75, 9, 75, 10, 75, 7, 75, 8, 74, 7, 74, 8], [77, 7, 77, 8, 76, 7, 76, 8, 76, 9, 76, 10], [75, 1, 75, 2, 76, 1, 76, 2, 76, 3, 76, 4], [77, 3, 77, 4, 77, 1, 77, 2, 78, 1, 78, 2], [77, 5, 77, 6, 77, 3, 77, 4, 76, 3, 76, 4], [79, 3, 79, 4, 78, 3, 78, 4, 78, 5, 78, 6], [75, 5, 75, 6, 76, 5, 76, 6, 76, 7, 76, 8], [77, 7, 77, 8, 77, 5, 77, 6, 78, 5, 78, 6], [77, 9, 77, 10, 77, 7, 77, 8, 76, 7, 76, 8], [79, 7, 79, 8, 78, 7, 78, 8, 78, 9, 78, 10], [77, 1, 77, 2, 78, 1, 78, 2, 78, 3, 78, 4], [79, 5, 79, 6, 79, 3, 79, 4, 78, 3, 78, 4], [77, 5, 77, 6, 78, 5, 78, 6, 78, 7, 78, 8], [79, 9, 79, 10, 79, 7, 79, 8, 78, 7, 78, 8], [81, 1, 81, 2, 80, 1, 80, 2, 80, 3, 80, 4], [81, 5, 81, 6, 80, 5, 80, 6, 80, 7, 80, 8], [81, 3, 81, 4, 81, 1, 81, 2, 80, 1, 80, 2], [83, 1, 83, 2, 82, 1, 82, 2, 82, 3, 82, 4], [81, 5, 81, 6, 81, 3, 81, 4, 82, 3, 82, 4], [81, 7, 81, 8, 81, 5, 81, 6, 80, 5, 80, 6], [83, 5, 83, 6, 82, 5, 82, 6, 82, 7, 82, 8], [81, 9, 81, 10, 81, 7, 81, 8, 82, 7, 82, 8], [83, 3, 83, 4, 83, 1, 83, 2, 82, 1, 82, 2], [85, 1, 85, 2, 84, 1, 84, 2, 84, 3, 84, 4], [81, 3, 81, 4, 82, 3, 82, 4, 82, 5, 82, 6], [83, 5, 83, 6, 83, 3, 83, 4, 84, 3, 84, 4], [83, 7, 83, 8, 83, 5, 83, 6, 82, 5, 82, 6], [85, 5, 85, 6, 84, 5, 84, 6, 84, 7, 84, 8], [81, 7, 81, 8, 82, 7, 82, 8, 82, 9, 82, 10], [83, 9, 83, 10, 83, 7, 83, 8, 84, 7, 84, 8], [85, 3, 85, 4, 85, 1, 85, 2, 84, 1, 84, 2], [87, 1, 87, 2, 86, 1, 86, 2, 86, 3, 86,

TABLE 32-continued

4], [83, 3, 83, 4, 84, 3, 84, 4, 84, 5, 84, 6], [85, 5, 85, 6, 85, 3, 85, 4, 86, 3, 86, 4], [85, 7, 85, 8, 85, 5, 85, 6, 84, 5, 84, 6], [87, 5, 87, 6, 86, 5, 86, 6, 86, 7, 86, 8], [83, 7, 83, 8, 84, 7, 84, 8, 84, 9, 84, 10], [85, 9, 85, 10, 85, 7, 85, 8, 86, 7, 86, 8], [87, 3, 87, 4, 87, 1, 87, 2, 86, 1, 86, 2], [89, 1, 89, 2, 88, 1, 88, 2, 88, 3, 88, 4], [85, 3, 85, 4, 86, 3, 86, 4, 86, 5, 86, 6], [87, 5, 87, 6, 87, 3, 87, 4, 88, 3, 88, 4], [87, 7, 87, 8, 87, 5, 87, 6, 86, 5, 86, 6], [89, 5, 89, 6, 88, 5, 88, 6, 88, 7, 88, 8], [85, 7, 85, 8, 86, 7, 86, 8, 86, 9, 86, 10], [87, 9, 87, 10, 87, 7, 87, 8, 88, 7, 88, 8], [89, 3, 89, 4, 89, 1, 89, 2, 88, 1, 88, 2], [87, 3, 87, 4, 88, 3, 88, 4, 88, 5, 88, 6], [89, 7, 89, 8, 89, 5, 89, 6, 88, 5, 88, 6], [87, 7, 87, 8, 88, 7, 88, 8, 88, 9, 88, 10], [91, 3, 91, 4, 90, 3, 90, 4, 90, 5, 90, 6], [91, 7, 91, 8, 90, 7, 90, 8, 90, 9, 90, 10], [91, 3, 91, 4, 91, 1, 91, 2, 92, 1, 92, 2], [91, 5, 91, 6, 91, 3, 91, 4, 90, 3, 90, 4], [93, 3, 93, 4, 92, 3, 92, 4, 92, 5, 92, 6], [91, 7, 91, 8, 91, 5, 91, 6, 92, 5, 92, 6], [91, 9, 91, 10, 91, 7, 91, 8, 90, 7, 90, 8], [93, 7, 93, 8, 92, 7, 92, 8, 92, 9, 92, 10], [91, 1, 91, 2, 92, 1, 92, 2, 92, 3, 92, 4], [93, 3, 93, 4, 93, 1, 93, 2, 94, 1, 94, 2], [93, 5, 93, 6, 93, 3, 93, 4, 92, 3, 92, 4], [95, 3, 95, 4, 94, 3, 94, 4, 94, 5, 94, 6], [91, 5, 91, 6, 92, 5, 92, 6, 92, 7, 92, 8], [93, 7, 93, 8, 93, 5, 93, 6, 94, 5, 94, 6], [93, 9, 93, 10, 93, 7, 93, 8, 92, 7, 92, 8], [95, 7, 95, 8, 94, 7, 94, 8, 94, 9, 94, 10], [93, 1, 93, 2, 94, 1, 94, 2, 94, 3, 94, 4], [95, 3, 95, 4, 95, 1, 95, 2, 96, 1, 96, 2], [95, 5, 95, 6, 95, 3, 95, 4, 94, 3, 94, 4], [97, 3, 97, 4, 96, 3, 96, 4, 96, 5, 96, 6], [93, 5, 93, 6, 94, 5, 94, 6, 94, 7, 94, 8], [95, 7, 95, 8, 95, 5, 95, 6, 95, 6, 96, 6], [95, 9, 95, 10, 95, 7, 95, 8, 94, 7, 94, 8], [97, 7, 97, 8, 96, 7, 96, 8, 96, 9, 96, 10], [95, 1, 95, 2, 96, 1, 96, 2, 96, 3, 96, 4], [97, 3, 97, 4, 97, 1, 97, 2, 98, 1, 98, 2], [97, 5, 97, 6, 97, 3, 97, 4, 96, 3, 96, 4], [99, 3, 99, 4, 98, 3, 98, 4, 98, 5, 98, 6], [95, 5, 95, 6, 96, 5, 96, 6, 96, 7, 96, 8], [97, 7, 97, 8, 97, 5, 97, 6, 98, 5, 98, 6], [97, 9, 97, 10, 97, 7, 97, 8, 96, 7, 96, 8], [99, 7, 99, 8, 98, 7, 98, 8, 98, 9, 98, 10], [97, 1, 97, 2, 98, 1, 98, 2, 98, 3, 98, 4], [99, 5, 99, 6, 99, 3, 99, 4, 98, 3, 98, 4], [97, 5, 97, 6, 98, 5, 98, 6, 98, 7, 98, 8], [99, 9, 99, 10, 99, 7, 99, 8, 98, 7, 98, 8], [0, 4, 0, 5, 0, 2, 0, 3, 19, 2, 19, 3], [20, 4, 20, 5, 19, 4, 19, 5, 19, 6, 19, 7], [0, 8, 0, 9, 0, 6, 0, 7, 19, 6, 19, 7], [18, 4, 18, 5, 1, 4, 1, 5, 1, 6, 1, 7], [2, 4, 2, 5, 2, 2, 2, 3, 17, 2, 17, 3], [22, 4, 22, 5, 17, 4, 17, 5, 17, 6, 17, 7], [2, 8, 2, 9, 2, 6, 2, 7, 17, 6, 17, 7], [16, 4, 16, 5, 3, 4, 3, 5, 3, 6, 3, 7], [4, 4, 4, 5, 4, 2, 4, 3, 15, 2, 15, 3], [24, 4, 24, 5, 15, 4, 15, 5, 15, 6, 15, 7], [4, 8, 4, 9, 4, 6, 4, 7, 15, 6, 15, 7], [14, 4, 14, 5, 5, 4, 5, 5, 5, 6, 5, 7], [6, 4, 6, 5, 6, 2, 6, 3, 13, 2, 13, 3], [26, 4, 26, 5, 13, 4, 13, 5, 13, 6, 13, 7], [6, 8, 6, 9, 6, 6, 6, 7, 13, 6, 13, 7], [12, 4, 12, 5, 7, 4, 7, 5, 7, 6, 7, 7], [8, 4, 8, 5, 8, 2, 8, 3, 11, 2, 11, 3], [28, 4, 28, 5, 11, 4, 11, 5, 11, 6, 11, 7], [8, 8, 8, 9, 8, 6, 8, 7, 11, 6, 11, 7], [10, 4, 10, 5, 9, 4, 9, 5, 9, 6, 9, 7], [10, 4, 10, 5, 10, 2, 10, 3, 29, 2, 29, 3], [10, 6, 10, 7, 10, 4, 10, 5, 9, 4, 9, 5], [30, 4, 30, 5, 29, 4, 29, 5, 29, 6, 29, 7], [10, 8, 10, 9, 10, 6, 10, 7, 29, 6, 29, 7], [12, 4, 12, 5, 12, 2, 12, 3, 27, 2, 27, 3], [12, 6, 12, 7, 12, 4, 12, 5, 7, 4, 7, 5], [32, 4, 32, 5, 27, 4, 27, 5, 27, 6, 27, 7], [12, 8, 12, 9, 12, 6, 12, 7, 27, 6, 27, 7], [14, 4, 14, 5, 14, 2, 14, 3, 25, 2, 25, 3], [14, 6, 14, 7, 14, 4, 14, 5, 4, 5, 5], [34, 4, 34, 5, 25, 4, 25, 5, 25, 6, 25, 7], [14, 8, 14, 9, 14, 6, 14, 7, 25, 6, 25, 7], [16, 4, 16, 5, 16, 2, 16, 3, 23, 2, 23, 3], [16, 6, 16, 7, 16, 4, 16, 5, 3, 4, 3, 5], [36, 4, 36, 5, 23, 4, 23, 5, 23, 6, 23, 7], [16, 8, 16, 9, 16, 6, 16, 7, 23, 6, 23, 7], [18, 4, 18, 5, 18, 2, 18, 3, 21, 2, 21, 3], [18, 6, 18, 7, 18, 4, 18, 5, 1, 4, 1, 5], [38, 4, 38, 5, 21, 4, 21, 5, 21, 6, 21, 7], [18, 8, 18, 9, 18, 6, 18, 7, 21, 6, 21, 7], [0, 2, 0, 3, 19, 2, 19, 3, 19, 4, 19, 5], [20, 4, 20, 5, 20, 2, 20, 3, 39, 2, 39, 3], [20, 6, 20, 7, 20, 4, 20, 5, 19, 4, 19, 5], [40, 4, 40, 5, 39, 4, 39, 5, 39, 6, 39, 7], [0, 6, 0, 7, 19, 6, 19, 7, 19, 8, 19, 9], [20, 8, 20, 9, 20, 6, 20, 7, 39, 6, 39, 7], [2, 2, 2, 3, 17, 2, 17, 3, 17, 4, 17, 5], [22, 4, 22, 5, 22, 2, 22, 3, 37, 2, 37, 3], [22, 6, 22, 7, 22, 4, 22, 5, 17, 4, 17, 5], [42, 4, 42, 5, 37, 4, 37, 5, 37, 6, 37, 7], [2, 6, 2, 7, 17, 6, 17, 7, 17, 8, 17, 9], [22, 8, 22, 9, 22, 6, 22, 7, 37, 6, 37, 7], [4, 2, 4, 3, 15, 2, 15, 3, 15, 4, 15, 5], [24, 4, 24, 5, 24, 2, 24, 3, 35, 2, 35, 3], [24, 6, 24, 7, 24, 4, 24, 5, 15, 4, 15, 5], [44, 4, 44, 5, 35, 4, 35, 5, 35, 6, 35, 7], [4, 6, 4, 7, 15, 6, 15, 7, 15, 8, 15, 9], [24, 8, 24, 9, 24, 6, 24, 7, 35, 6, 35, 7], [6, 2, 6, 3, 13, 2, 13, 3, 13, 4, 13, 5], [26, 4, 26, 5, 26, 2, 26, 3, 33, 2, 33, 3], [26, 6, 26, 7, 26, 4, 26, 5, 13, 4, 13, 5], [46, 4, 46, 5, 33, 4, 33, 5, 33, 6, 33, 7], [6, 6, 6, 7, 13, 6, 13, 7, 13, 8, 13, 9], [26, 8, 26, 9, 26, 6, 26, 7, 33, 6, 33, 7], [8, 2, 8, 3, 11, 2, 11, 3, 11, 4, 11, 5], [28, 4, 28, 5, 28, 2, 28, 3, 31, 2, 31, 3], [28, 6, 28, 7, 28, 4, 28, 5, 11, 4, 11, 5], [48, 4, 48, 5, 31, 4, 31, 5, 31, 6, 31, 7], [8, 6, 8, 7, 11, 6, 11, 7, 11, 8, 11, 9], [28, 8, 28, 9, 28, 6, 28, 7, 31, 6, 31, 7], [10, 2, 10, 3, 29, 2, 29, 3, 29, 4, 29, 5], [30, 4, 30, 5, 30, 2, 30, 3, 49, 2, 49, 3], [30, 6, 30, 7, 30, 4, 30, 5, 29, 4, 29, 5], [50, 4, 50, 5, 49, 4, 49, 5, 49, 6, 49, 7], [10, 6, 10, 7, 29, 6, 29, 7, 29, 8, 29, 9], [30, 8, 30, 9, 30, 6, 30, 7, 49, 6, 49, 7], [12, 2, 12, 3, 27, 2, 27, 3, 27, 4, 27, 5], [32, 4, 32, 5, 32, 2, 32, 3, 47, 2, 47, 3], [32, 6, 32, 7, 32, 4, 32, 5, 27, 4, 27, 5], [52, 4, 52, 5, 47, 4, 47, 5, 47, 6, 47, 7], [12, 6, 12, 7, 27, 6, 27, 7, 27, 8, 27, 9], [32, 8, 32, 9, 32, 6, 32, 7, 47, 6, 47, 7], [14, 2, 14, 3, 25, 2, 25, 3, 25, 4, 25, 5], [34, 4, 34, 5, 34, 2, 34, 3, 45, 2, 45, 3], [34, 6, 34, 7, 34, 4, 34, 5, 25, 4, 25, 5], [54, 4, 54, 5, 45, 4, 45, 5, 45, 6, 45, 7], [14, 6, 14, 7, 25, 6, 25, 7, 25, 8, 25, 9], [34, 8, 34, 9, 34, 6, 34, 7, 45, 6, 45, 7], [16, 2, 16, 3, 23, 2, 23, 3, 23, 4, 23, 5], [36, 4, 36, 5, 36, 2, 36, 3, 43, 2, 43, 3], [36, 6, 36, 7, 36, 4, 36, 5, 23, 4, 23, 5], [56, 4, 56, 5, 43, 4, 43, 5, 43, 6, 43, 7], [16, 6, 16, 7, 23, 6, 23, 7, 23, 8, 23, 9], [36, 8, 36, 9, 36, 6, 36, 7, 43, 6, 43, 7], [18, 2, 18, 3, 21, 2, 21, 3, 21, 4, 21, 5], [38, 4, 38, 5, 38, 2, 38, 3, 41, 2, 41, 3], [38, 6, 38, 7, 38, 4, 38, 5, 21, 4, 21, 5], [58, 4, 58, 5, 41, 4, 41, 5, 41, 6, 41, 7], [18, 6, 18, 7, 21, 6, 21, 7, 21, 8, 21, 9], [38, 8, 38, 9, 38, 6, 38, 7, 41, 6, 41, 7], [20, 2, 20, 3, 39, 2, 39, 3, 39, 4, 39, 5], [40, 4, 40, 5, 40, 2, 40, 3, 59, 2, 59, 3], [40, 6, 40, 7, 40, 4, 40, 5, 39, 4, 39, 5], [60, 4, 60, 5, 59, 4, 59, 5, 59, 6, 59, 7], [20, 6, 20, 7, 39, 6, 39, 7, 39, 8, 39, 9], [40, 8, 40, 9, 40, 6, 40, 7, 59, 6, 59, 7], [22, 2, 22, 3, 37, 2, 37, 3, 37, 4, 37, 5], [42, 4, 42, 5, 42, 2, 42, 3, 57, 2, 57, 3], [42, 6, 42, 7, 42, 4, 42, 5, 37, 4, 37, 5], [62, 4, 62, 5, 57, 4, 57, 5, 57, 6, 57, 7], [22, 6, 22, 7, 37, 6, 37, 7, 37, 8, 37, 9], [42, 8, 42, 9, 42, 6, 42, 7, 57, 6, 57, 7], [24, 2, 24, 3, 35, 2, 35, 3, 35, 4, 35, 5], [44, 4, 44, 5, 44, 2, 44, 3, 55, 2, 55, 3], [44, 6, 44, 7, 44, 4, 44, 5, 35, 4, 35, 5], [64, 4, 64, 5, 55, 4, 55, 5, 55, 6, 55, 7], [24, 6, 24, 7, 35, 6, 35, 7, 35, 8, 35, 9], [44, 8, 44, 9, 44, 6, 44, 7, 55, 6, 55, 7], [26, 2, 26, 3, 33, 2, 33, 3, 33, 4, 33, 5], [46, 4, 46, 5, 46, 2, 46, 3, 53, 2, 53, 3], [46, 6, 46, 7, 46, 4, 46, 5, 33, 4, 33, 5], [66, 4, 66, 5, 53, 4, 53, 5, 53, 6, 53, 7], [26, 6, 26, 7, 33, 6, 33, 7, 33, 8, 33, 9], [46, 8, 46, 9, 46, 6, 46, 7, 53, 6, 53, 7], [28, 2, 28, 3, 31, 2, 31, 3, 31, 4, 31, 5], [48, 4, 48, 5, 48, 2, 48, 3, 51, 2, 51, 3], [48, 6, 48, 7, 48, 4, 48, 5, 31, 4, 31, 5], [68, 4, 68, 5, 51, 4, 51, 5, 51, 6, 51, 7], [28, 6, 28, 7, 31, 6, 31, 7, 31, 8, 31, 9], [48, 8, 48, 9, 48, 6, 48, 7, 51, 6, 51, 7], [30, 2, 30, 3, 49, 2, 49, 3, 49, 4, 49, 5], [50, 4, 50, 5, 50, 2, 50, 3, 69, 2, 69, 3], [50, 6, 50, 7, 50, 4, 50, 5, 49, 4, 49, 5], [70, 4, 70, 5, 69, 4, 69, 5, 69, 6, 69, 7], [30, 6, 30, 7, 49, 6, 49, 7, 49, 8, 49, 9], [50, 8, 50, 9, 50, 6, 50, 7, 69, 6, 69, 7], [32, 2, 32, 3, 47, 2, 47, 3, 47, 4, 47, 5], [52, 4, 52, 5, 52, 2, 52, 3, 67, 2, 67, 3], [52, 6, 52, 7, 52, 4, 52, 5, 47, 4, 47, 5], [72, 4, 72, 5, 67, 4, 67, 5, 67, 6, 67, 7], [32, 6, 32, 7, 47, 6, 47, 7, 47, 8, 47, 9], [52, 8, 52, 9, 52, 6, 52, 7, 67, 6, 67, 7], [34, 2, 34, 3, 45, 2, 45, 3, 45, 4, 45, 5], [54, 4, 54, 5, 54, 2, 54, 3, 65, 2, 65, 3], [54, 6, 54, 7, 54, 4, 54, 5, 45, 4, 45, 5], [74, 4, 74, 5, 65, 4, 65, 5, 65, 6, 65, 7], [34, 6, 34, 7, 45, 6, 45, 7, 45, 8, 45, 9], [54, 8, 54, 9, 54, 6, 54, 7, 65, 6, 65, 7], [36, 2, 36, 3, 43, 2, 43, 3, 43, 4, 43, 5], [56, 4, 56, 5, 56, 2, 56, 3, 63, 2, 63, 3], [56, 6, 56, 7, 56, 4, 56, 5, 43, 4, 43, 5], [76, 4, 76, 5, 63, 4, 63, 5, 63, 6, 63, 7], [36, 6, 36, 7, 43, 6, 43, 7, 43, 8, 43, 9], [56, 8, 56, 9, 56, 6, 56, 7, 63, 6, 63, 7], [38, 2, 38, 3, 41, 2, 41, 3, 41, 4, 41, 5], [58, 4, 58, 5, 58, 2, 58, 3, 61, 2, 61, 3], [58, 6, 58, 7, 58, 4, 58, 5, 41, 4, 41, 5], [78, 4, 78, 5, 61, 4, 61, 5, 61, 6, 61, 7], [38, 6, 38, 7, 41, 6, 41, 7, 41, 8, 41, 9], [58, 8, 58, 9, 58, 6, 58, 7, 61, 6, 61, 7], [40, 2, 40, 3, 59, 2, 59, 3, 59, 4, 59, 5], [60, 4, 60, 5, 60, 2, 60, 3, 79, 2, 79, 3], [60, 6, 60, 7, 60, 4, 60, 5, 59, 4, 59, 5], [80, 4, 80, 5, 79, 4, 79, 5, 79, 6, 79, 7], [40, 6, 40, 7, 59, 6, 59, 7, 59, 8, 59, 9], [60, 8, 60, 9, 60, 6, 60, 7, 79, 6, 79, 7], [42, 2, 42, 3, 57, 2, 57, 3, 57, 4, 57, 5], [62, 4, 62, 5, 62, 2, 62, 3, 77, 2, 77, 3], [62, 6, 62, 7, 62, 4, 62, 5, 57, 4, 57, 5], [82, 4, 82, 5, 77, 4, 77, 5, 77, 6, 77, 7], [42, 6, 42, 7, 57, 6, 57, 7, 57, 8, 57, 9], [62, 8, 62, 9, 62, 6, 62, 7, 77, 6, 77, 7], [44, 2, 44, 3, 55, 2, 55, 3, 55, 4, 55, 5], [64, 4, 64, 5, 64, 2, 64, 3, 75, 2, 75, 3], [64, 6, 64, 7, 64, 4, 64, 5, 55, 4, 55, 5], [84, 4, 84, 5, 75, 4, 75, 5, 75, 6, 75, 7], [44, 6, 44, 7, 55, 6, 55, 7, 55, 8, 55, 9], [64, 8, 64, 9, 64, 6, 64, 7, 75, 6, 75, 7], [46, 2, 46, 3, 53, 2, 53, 3, 53, 4, 53, 5], [66, 4, 66, 5, 66, 2, 66, 3, 73, 2, 73, 3], [66, 6, 66, 7, 66, 4, 66, 5, 53, 4, 53, 5], [86, 4, 86, 5, 73, 4, 73, 5, 73, 6, 73, 7], [46, 6, 46, 7, 53, 6, 53, 7, 53, 8, 53, 9], [66, 8, 66, 9, 66, 6, 66, 7, 73, 6, 73, 7], [48, 2, 48, 3, 51, 2, 51, 3, 51, 4, 51, 5], [68, 4, 68, 5, 68, 2, 68, 3, 71, 2, 71, 3], [68, 6, 68, 7, 68, 4, 68, 5, 51, 4, 51, 5], [88, 4, 88, 5, 71, 4, 71, 5, 71, 6, 71, 7], [48, 6, 48, 7, 51, 6, 51, 7, 51, 8, 51, 9], [68, 8, 68, 9, 68, 6, 68, 7, 71, 6, 71, 7], [50, 2, 50, 3, 69, 2, 69, 3, 69, 4, 69, 5], [70, 4, 70, 5, 70, 2, 70, 3, 89, 2, 89, 3], [70, 6, 70, 7, 70, 4, 70, 5, 69, 4, 69, 5], [90, 4, 90, 5, 89, 4, 89, 5, 89, 6, 89, 7], [50, 6, 50, 7, 69, 6, 69, 7, 69, 8, 69, 9], [70, 8, 70, 9, 70, 6, 70, 7, 89, 6, 89, 7], [52, 2, 52, 3, 67, 2, 67, 3, 67, 4, 67, 5], [72, 4, 72, 5, 72, 2, 72, 3, 87, 2, 87, 3], [72, 6, 72, 7, 72, 4, 72, 5, 67, 4, 67, 5], [92, 4, 92, 5, 87, 4, 87, 5, 87, 6, 87, 7], [52, 6, 52, 7, 67, 6, 67, 7, 67, 8, 67, 9], [72, 8, 72, 9, 72, 6, 72, 7, 87, 6, 87, 7], [54, 2, 54, 3, 65, 2, 65, 3, 65, 4, 65, 5], [74, 4, 74, 5, 74, 2, 74, 3, 85, 2, 85, 3], [74, 6, 74, 7, 74, 4, 74, 5, 65, 4, 65, 5], [94, 4, 94, 5, 85, 4, 85, 5, 85, 6, 85, 7], [54, 6, 54, 7, 65, 6, 65, 7, 65, 8, 65, 9], [74, 8, 74, 9, 74, 6, 74, 7, 85, 6, 85, 7], [56, 2, 56, 3, 63, 2, 63, 3, 63, 4, 63, 5], [76, 4, 76, 5, 76, 2, 76, 3, 83, 2, 83, 3], [76, 6, 76, 7, 76, 4, 76, 5, 63, 4, 63, 5], [96, 4, 96, 5, 83, 4, 83, 5, 83, 6, 83, 7], [56, 6, 56, 7, 63, 6, 63, 7, 63, 8, 63, 9], [76, 8, 76, 9, 76, 6, 76, 7, 83, 6, 83, 7], [58, 2, 58, 3, 61, 2, 61, 3, 61, 4, 61, 5], [78, 4, 78, 5, 78, 2, 78, 3, 81, 2, 81, 3], [78, 6, 78, 7, 78, 4, 78, 5, 61, 4, 61, 5], [98, 4, 98, 5, 81, 4, 81, 5, 81, 6, 81, 7], [58, 6, 58, 7, 61, 6, 61, 7, 61, 8, 61, 9], [78, 8, 78, 9, 78, 6, 78, 7, 81, 6, 81, 7], [60, 2, 60, 3, 79, 2, 79, 3, 79, 4, 79, 5], [80, 4, 80, 5, 80, 2, 80, 3, 99, 2, 99, 3],

TABLE 32-continued

[80, 6, 80, 7, 80, 4, 80, 5, 79, 4, 79, 5], [60, 6, 60, 7, 79, 6, 79, 7, 79, 8, 79, 9], [80, 8, 80, 9, 80, 6, 80, 7, 99, 6, 99, 7], [62, 2, 62, 3, 77, 2, 77, 3, 77, 4, 77, 5], [82, 4, 82, 5, 82, 2, 82, 3, 97, 2, 97, 3], [82, 6, 82, 7, 82, 4, 82, 5, 77, 4, 77, 5], [62, 6, 62, 7, 77, 6, 77, 7, 77, 8, 77, 9], [82, 8, 82, 9, 82, 6, 82, 7, 97, 6, 97, 7], [64, 2, 64, 3, 75, 2, 75, 3, 75, 4, 75, 5], [84, 4, 84, 5, 84, 2, 84, 3, 95, 2, 95, 3], [84, 6, 84, 7, 84, 4, 84, 5, 75, 4, 75, 5], [64, 6, 64, 7, 75, 6, 75, 7, 75, 8, 75, 9], [84, 8, 84, 9, 84, 6, 84, 7, 95, 6, 95, 7], [66, 2, 66, 3, 73, 2, 73, 3, 73, 4, 73, 5], [86, 4, 86, 5, 86, 2, 86, 3, 93, 2, 93, 3], [86, 6, 86, 7, 86, 4, 86, 5, 73, 4, 73, 5], [66, 6, 66, 7, 73, 6, 73, 7, 73, 8, 73, 9], [86, 8, 86, 9, 86, 6, 86, 7, 93, 6, 93, 7], [68, 2, 68, 3, 71, 2, 71, 3, 71, 4, 71, 5], [88, 4, 88, 5, 88, 2, 88, 3, 91, 2, 91, 3], [88, 6, 88, 7, 88, 4, 88, 5, 71, 4, 71, 5], [68, 6, 68, 7, 71, 6, 71, 7, 71, 8, 71, 9], [88, 8, 88, 9, 88, 6, 88, 7, 91, 6, 91, 7], [70, 2, 70, 3, 89, 2, 89, 3, 89, 4, 89, 5], [90, 6, 90, 7, 90, 4, 90, 5, 89, 4, 89, 5], [70, 6, 70, 7, 89, 6, 89, 7, 89, 8, 89, 9], [88, 2, 88, 3, 91, 2, 91, 3, 91, 4, 91, 5], [88, 6, 88, 7, 91, 6, 91, 7, 91, 8, 91, 9], [72, 2, 72, 3, 87, 2, 87, 3, 87, 4, 87, 5], [92, 6, 92, 7, 92, 4, 92, 5, 87, 4, 87, 5], [72, 6, 72, 7, 87, 6, 87, 7, 87, 8, 87, 9], [86, 2, 86, 3, 93, 2, 93, 3, 93, 4, 93, 5], [86, 6, 86, 7, 93, 6, 93, 7, 93, 8, 93, 9], [74, 2, 74, 3, 85, 2, 85, 3, 85, 4, 85, 5], [94, 6, 94, 7, 94, 4, 94, 5, 85, 4, 85, 5], [74, 6, 74, 7, 85, 6, 85, 7, 85, 8, 85, 9], [84, 2, 84, 3, 95, 2, 95, 3, 95, 4, 95, 5], [84, 6, 84, 7, 95, 6, 95, 7, 95, 8, 95, 9], [76, 2, 76, 3, 83, 2, 83, 3, 83, 4, 83, 5], [96, 6, 96, 7, 96, 4, 96, 5, 83, 4, 83, 5], [76, 6, 76, 7, 83, 6, 83, 7, 83, 8, 83, 9], [82, 2, 82, 3, 97, 2, 97, 3, 97, 4, 97, 5], [82, 6, 82, 7, 97, 6, 97, 7, 97, 8, 97, 9], [78, 2, 78, 3, 81, 2, 81, 3, 81, 4, 81, 5], [98, 6, 98, 7, 98, 4, 98, 5, 81, 4, 81, 5], [78, 6, 78, 7, 81, 6, 81, 7, 81, 8, 81, 9], [80, 2, 80, 3, 99, 2, 99, 3, 99, 4, 99, 5], [80, 6, 80, 7, 99, 6, 99, 7, 99, 8, 99, 9]

The oligonucleotide sequences used to produce 30H×1H×126B nucleic acid structures of the invention are designated SEQ ID NOs. 11297-11502, and the corresponding 5' end coordinates are shown respectively in Table 33. (See also Appendix, Table 16 of U.S. provisional application No. 61/675,309, filed Jul. 24, 2012, incorporated by reference herein.)

TABLE 33

[1, 23], [1, 39], [1, 55], [1, 71], [1, 87], [1, 103], [1, 119], [1, 135], [3, 23], [3, 39], [3, 55], [3, 71], [3, 87], [3, 103], [3, 119], [3, 135], [5, 23], [5, 39], [5, 55], [5, 71], [5, 87], [5, 103], [5, 119], [5, 135], [7, 23], [7, 39], [7, 55], [7, 71], [7, 87], [7, 103], [7, 119], [7, 135], [9, 23], [9, 39], [9, 55], [9, 71], [9, 87], [9, 103], [9, 119], [9, 135], [11, 23], [11, 39], [11, 55], [11, 71], [11, 87], [11, 103], [11, 119], [11, 135], [13, 23], [13, 39], [13, 55], [13, 71], [13, 87], [13, 103], [13, 119], [13, 135], [15, 23], [15, 39], [15, 55], [15, 71], [15, 87], [15, 103], [15, 119], [15, 135], [17, 23], [17, 39], [17, 55], [17, 71], [17, 87], [17, 103], [17, 119], [17, 135], [19, 23], [19, 39], [19, 55], [19, 71], [19, 87], [19, 103], [19, 119], [19, 135], [21, 23], [21, 39], [21, 55], [21, 71], [21, 87], [21, 103], [21, 119], [21, 135], [23, 23], [23, 39], [23, 55], [23, 71], [23, 87], [23, 103], [23, 119], [23, 135], [25, 23], [25, 39], [25, 55], [25, 71], [25, 87], [25, 103], [25, 119], [25, 135], [27, 23], [27, 39], [27, 55], [27, 71], [27, 87], [27, 103], [27, 119], [27, 135], [29, 39], [29, 71], [29, 103], [29, 135], [0, 47], [0, 95], [0, 143], [1, 0], [1, 48], [1, 96], [2, 47], [2, 95], [2, 143], [3, 0], [3, 48], [3, 96], [4, 47], [4, 95], [4, 143], [5, 0], [5, 48], [5, 96], [6, 47], [6, 95], [6, 143], [7, 0], [7, 48], [7, 96], [8, 47], [8, 95], [8, 143], [9, 0], [9, 48], [9, 96], [10, 47], [10, 95], [10, 143], [11, 0], [11, 48], [11, 96], [12, 47], [12, 95], [12, 143], [13, 0], [13, 48], [13, 96], [14, 47], [14, 95], [14, 143], [15, 0], [15, 48], [15, 96], [16, 47], [16, 95], [16, 143], [17, 0], [17, 48], [17, 96], [18, 47], [18, 95], [18, 143], [19, 0], [19, 48], [19, 96], [20, 47], [20, 95], [20, 143], [21, 0], [21, 48], [21, 96], [22, 47], [22, 95], [22, 143], [23, 0], [23, 48], [23, 96], [24, 47], [24, 95], [24, 143], [25, 0], [25, 48], [25, 96], [26, 47], [26, 95], [26, 143], [27, 0], [27, 48], [27, 96], [28, 47], [28, 95], [28, 143], [29, 0], [29, 48], [29, 96]

The oligonucleotide sequences used to produce 6H×6H×84B-HC nucleic acid structures of the invention are designated SEQ ID NOs. 11503-11667, and the corresponding 5' end coordinates are shown respectively in Table 34. (See also Appendix, Table 17 of U.S. provisional application No. 61/675,309, filed Jul. 24, 2012, incorporated by reference herein.)

TABLE 34

[0, 47], [0, 89], [1, 46], [1, 64], [1, 88], [1, 106], [3, 46], [3, 64], [3, 88], [3, 106], [5, 46], [5, 64], [5, 88], [5, 106], [6, 23], [7, 46], [7, 64], [7, 88], [7, 106], [9, 46], [9, 64], [9, 88], [9, 106], [11, 46], [11, 88], [11, 106], [12, 47], [12, 89], [13, 46], [13, 64], [13, 88], [13, 106], [15, 46], [15, 64], [15, 88], [15, 106], [17, 46], [17, 64], [17, 88], [17, 106], [18, 23], [19, 46], [19, 64], [19, 88], [19, 106], [21, 46], [21, 64], [21, 88], [21, 106], [23, 46], [23, 88], [23, 106], [24, 47], [24, 89], [25, 46], [25, 64], [25, 88], [25, 106], [27, 46], [27, 64], [27, 88], [27, 106], [29, 46], [29, 64], [29, 88], [29, 106], [30, 23], [31, 46], [31, 64], [31, 88], [31, 106], [33, 46], [33, 64], [33, 88], [33, 106], [35, 46], [35, 88], [35, 106], [0, 55], [0, 111], [2, 55], [2, 111], [4, 55], [4, 111], [6, 34], [6, 55], [6, 76], [6, 97], [6, 118], [8, 34], [8, 55], [8, 76], [8, 97], [8, 118], [10, 34], [10, 55], [10, 76], [10, 97], [10, 118], [12, 34], [12, 55], [12, 76], [12, 97], [12, 118], [14, 34], [14, 55], [14, 76], [14, 97], [14, 118], [16, 34], [16, 55], [16, 76], [16, 97], [16, 118], [18, 34], [18, 55], [18, 76], [18, 97], [18, 118], [20, 34], [20, 55], [20, 76], [20, 97], [20, 118], [22, 34], [22, 55], [22, 76], [22, 97], [22, 118], [24, 34], [24, 55], [24, 76], [24, 97], [24, 118], [26, 34], [26, 55], [26, 76], [26, 97], [26, 118], [28, 34], [28, 55], [28, 76], [28, 97], [28, 118], [30, 34], [30, 55], [30, 76], [30, 97], [30, 118], [31, 14], [31, 56], [32, 34], [32, 55], [32, 76], [32, 97], [32, 118], [33, 14], [33, 56], [34, 34], [34, 55], [34, 76], [34, 97], [34, 118], [35, 14], [35, 56]

The oligonucleotide sequences used to produce 6H×7H×108B-HL nucleic acid structures of the invention are designated SEQ ID NOs. 11668-11935, and the corresponding 5' end coordinates are shown respectively in Table 35. (See also Appendix, Table 18 of U.S. provisional application No. 61/675,309, filed Jul. 24, 2012, incorporated by reference herein.)

TABLE 35

[0, 26], [0, 56], [0, 104], [1, 79], [1, 133], [2, 26], [2, 56], [2, 104], [3, 79], [3, 133], [4, 26], [4, 56], [4, 104], [5, 79], [5, 133], [6, 26], [6, 80], [7, 55], [7, 103], [7, 133], [8, 32], [8, 80], [9, 55], [9, 103], [9, 133], [10, 32], [10, 80], [11, 55], [11, 103], [11, 133], [12, 26], [12, 56], [12, 104], [13, 79], [13, 133], [14, 26], [14, 56], [14, 104], [15, 79], [15, 133], [16, 26], [16, 56], [16, 104], [17, 79], [17, 133], [18, 26], [18, 72], [18, 88], [19, 71], [19, 87], [19, 133], [20, 26], [20, 72], [20, 88], [21, 71], [21, 87], [21, 133], [22, 26], [22, 72], [22, 88], [23, 71], [23, 87], [23, 133], [24, 26], [24, 80], [25, 55], [25, 103], [25, 133], [26, 32], [26, 80], [27, 55], [27, 103], [27, 133], [28, 32], [28, 80], [29, 55], [29, 103], [29, 133], [30, 26], [30, 56], [30, 104], [31, 79], [31, 133], [32, 26], [32, 56], [32, 104], [33, 79], [33, 133], [34, 26], [34, 56], [34, 104], [35, 79], [35, 133], [36, 26], [36, 80], [37, 71], [37, 87], [37, 133], [38, 26], [38, 72], [38, 88], [39, 71], [39, 87], [39, 133], [40, 26], [40, 72], [40, 88], [41, 63], [41, 87], [41, 133], [0, 47], [0, 79], [0, 95], [0, 127], [1, 32], [2, 47], [2, 63], [2, 79], [2, 95], [2, 111], [2, 127], [3, 32], [4, 47], [4, 63], [4, 79], [4, 95], [4, 111], [4, 127], [5, 32], [5, 72], [6, 55], [6, 71], [6, 103], [6, 119], [6, 127], [8, 39], [8, 55], [8, 71], [8, 87], [8, 103], [8, 119], [8, 127], [10, 39], [10, 55], [10, 71], [10, 87], [10, 103], [10, 119], [10, 127], [12, 63], [12, 71], [12, 79], [12, 111], [12, 119], [12, 127], [13, 24], [14, 39], [14, 47], [14, 63], [14, 71], [14, 79], [14, 87], [14, 95], [14, 111], [14, 119], [14, 127], [15, 24], [16, 39], [16, 47], [16, 63], [16, 71], [16, 79], [16, 87], [16, 95], [16, 111], [16, 119], [16, 127], [17, 32], [18, 47], [18, 55], [18, 79], [18, 95], [18, 103], [18, 127], [20, 47], [20, 55], [20, 63], [20, 79], [20, 95], [20, 103], [20, 111], [20, 127], [22, 47], [22, 55], [22, 63], [22, 79], [22, 95], [22, 103], [22, 111], [22, 127], [24, 55], [24, 71], [24, 103], [24, 119], [24, 127], [26, 39], [26, 55], [26, 71], [26, 87], [26, 103], [26, 119], [26, 127], [28, 39], [28, 55], [28, 71], [28, 87], [28, 103], [28, 119], [28, 127], [30, 63], [30, 71], [30, 79], [30, 111], [30, 119], [30, 127], [31, 24], [32, 39], [32, 47], [32, 63], [32, 71], [32, 79], [32, 87], [32, 95], [32, 111], [32, 119], [32, 127], [33, 24], [34, 39], [34, 47], [34, 63], [34, 71], [34, 79], [34, 87], [34, 95], [34, 111], [34, 119], [34, 127], [35, 32], [36, 47], [36, 55], [36, 71], [36, 95], [36, 103], [36, 127], [38, 47], [38, 55], [38, 63], [38, 95], [38, 103], [38, 111], [38, 127], [40, 47], [40, 55], [40, 63], [40, 95], [40, 103], [40, 111], [40, 127]

The oligonucleotide sequences used to produce 6H×6H×64B (version 1) nucleic acid structures of the invention are designated SEQ ID NOs. 11936-12041, and the corresponding 5' end coordinates are shown respectively in Table 36. (See also Appendix, Table 19 of U.S. provisional application No. 61/675,309, filed Jul. 24, 2012, incorporated by reference herein.)

TABLE 36

[0, 26], [0, 85], [1, 58], [2, 43], [2, 85], [3, 58], [4, 40], [4, 85], [5, 75], [6, 52], [7, 43], [7, 84], [8, 59], [9, 41], [9, 84], [10, 59], [11, 41], [11, 100], [12, 26], [12, 85], [13, 58], [14, 43], [14, 85], [15, 58], [16, 43], [16, 85], [17, 67], [18, 43], [19, 58], [20, 44], [20, 85], [21, 58], [22, 44], [22, 85], [23, 51], [23, 100], [24, 26], [24, 85], [25, 58], [26, 43], [26, 85], [27, 58], [28, 43], [28, 85], [29, 67], [30,43], [31, 58], [32, 45], [32, 85], [33, 58], [34, 44], [34, 85], [35, 51], [35, 100], [0, 43], [0, 59], [1, 68], [1, 85], [2, 59], [2, 91], [3, 36],[3, 68], [4, 43], [4, 59], [4, 91], [5, 68], [6, 95], [11, 32], [12, 43], [12, 75], [13, 52], [13, 84], [14, 43], [14, 75], [15, 36], [15, 52], [15, 84], [16, 43], [16, 75], [17, 52], [17, 84], [18, 59], [18, 95], [19, 68], [20, 59], [21, 68], [21, 92], [22, 59], [23, 32], [23, 68], [26, 35], [27, 92], [30, 43], [30, 75], [30, 95], [31, 52], [31, 84], [32, 43], [32, 75], [33, 52], [33, 84], [34, 43], [34, 75], [35, 32], [35, 52], [35, 84]

The oligonucleotide sequences used to produce 6H×6H×64B (version 2) nucleic acid structures of the invention are designated SEQ ID NOs. 12042-12203, and the corresponding 5' end coordinates are shown respectively in Table 37. (See also Appendix, Table 20 of U.S. provisional application No. 61/675,309, filed Jul. 24, 2012, incorporated by reference herein.)

TABLE 37

[0, 28], [0, 60], [1, 35], [1, 67], [2, 28], [2, 60], [3, 35], [3, 67], [4, 28], [4, 60], [5, 35], [5, 67], [6, 12], [6, 44], [7, 19], [7, 51], [8, 44], [8, 76], [9, 19], [9, 51], [10, 44], [10, 76], [11, 51], [11, 83], [12, 28], [12, 60], [13, 35], [13, 67], [14, 28], [14, 60], [15, 35], [15, 67], [16, 28], [16, 60], [17, 35], [17, 67], [18, 12], [18, 44], [19, 19], [19, 51], [20, 44], [20, 76], [21, 19], [21, 51], [22, 44], [22, 76], [23, 51], [23, 83], [24, 28], [24, 60], [25, 35], [25, 67], [26, 28], [26, 60], [27, 35], [27, 67], [28, 28], [28, 60], [29, 35], [29, 67], [30, 12], [30, 44], [31, 19], [31, 51], [32, 44], [32, 76], [33, 19], [33, 51], [34, 44], [34, 76], [35, 51], [35, 83], [0, 43], [0, 75], [1, 20], [1, 52], [2, 43], [2, 75], [3, 20], [3, 52], [4, 43], [4, 75], [5, 20], [5, 52], [6, 27], [6, 59], [7, 36], [7, 68], [8, 27], [8, 59], [9, 36], [9, 68], [10, 27], [10, 59], [11, 36], [11, 68], [12, 11], [12, 43], [12, 75], [13, 20], [13, 52], [13, 84], [14, 11], [14, 43], [14, 75], [15, 20], [15, 52], [15, 84], [16, 11], [16, 43], [16, 75], [17, 20], [17, 52], [17, 84], [18, 27], [18, 59], [19, 68], [20, 27], [20, 59], [21, 36], [21, 68], [22, 27], [22, 59], [23, 36], [23, 68], [24, 11], [24, 43], [24, 75], [25, 20], [25, 52], [25, 84], [26, 11], [26, 43], [26, 75], [27, 20], [27, 52], [27, 84], [28, 11], [28, 43], [28, 75], [29, 20], [29, 52], [29, 84], [30, 27], [30, 59], [30, 91], [31, 4], [31, 36], [31, 68], [32, 27], [32, 59], [32, 91], [33, 4], [33, 36], [33, 68], [34, 27], [34, 59], [34, 91], [35, 4], [35, 36], [35, 68]

Single-Stranded Oligonucleotides

The nucleic acid structures of the invention are designed and made using a plurality of single-stranded oligonucleotides that anneal to each other in a sequence-specific manner. The oligonucleotides may be characterized by their length, their sequence, and their domain composition. The number and sequence of their domains governs the binding activity and location of each oligonucleotide. Their domain number typically governs the number of oligonucleotides each oligonucleotide will bind to in a structure.

In some instances, the oligonucleotides used to make a structure comprise an even number of domains. Each oligonucleotide typically comprises at least two domains. In some embodiments, oligonucleotides used to make a structure may be 2- and 4-domain oligonucleotides. It is also possible to form structures using other combinations of oligonucleotides including without limitation 2- and 6-domain oligonucleotides, 3- and 6-domain oligonucleotides, 2- and 8-domain oligonucleotides, 4- and 8-domain oligonucleotides, and the like.

A domain, as used herein, refers to a nucleotide sequence (i.e., a number of contiguous nucleotides or nucleotide analogs having the ability to bind in a sequence-specific manner to their complements). The domains in a plurality of oligonucleotides or in a nucleic acid structure are designed such that they anneal to domain in another oligonucleotide. The collective complementarity of all domains of an oligonucleotide facilitates the self-assembly of such oligonucleotides to form nucleic acid structures.

The domain length may vary. In situations where two contiguous domains from the same oligonucleotide are contributing to the same helix, the lengths of the two domains may be interrelated. As an example, one domain has a length of x and the other domain has a length of y, provided that x+y is about 16, provided that each of x and y is 1 or greater.

In some embodiments, two contiguous domains from the same oligonucleotide that contribute to the same helix may have a combined length of about 16+/−2 nucleotides in length. Thus, a single domain may have a length of, for example, 1, 2, 3, 4, 5, 6, 7, 8, 9, 10, 11, 12, 13, 14, 15, 16 or 17 nucleotides. Two contiguous domains may have a total combined length of, for example, 14, 15, 16, 17 or 18 nucleotides. A 2-domain oligonucleotide may have a length of, for example, 16+/−2 nucleotides. A 4-domain oligonucleotide may have a length of, for example, 32+/−4 nucleotides.

In some important embodiments, a domain has a length of 8 nucleotides, two contiguous domains have a length of 16 nucleotides, and a 4-domain oligonucleotide has a length of 32 nucleotides. It is to be understood that the invention contemplates oligonucleotides having two contiguous domains (both contributing to a single helix) that have a length that is a multiple of 16 nucleotides.

Typically in a given synthesis method or resultant structure, oligonucleotides having the same number of domains will also have the same length. As an example, in one embodiment, all 4-domain oligonucleotides will be the same length and all 2-domain oligonucleotides will be the same length (but that length will be different from that of the 4-domain oligonucleotides). More specifically, some embodiments will use 4-domain oligonucleotides that are one length (e.g., n nucleotides) and 2-domain oligonucleotides that are half that length (e.g., n/2 nucleotides).

The invention contemplates nucleic acid structures comprising any number of single-stranded oligonucleotides. As an example, the nucleic acid structures may comprise as few as 4 and as many as 1000 (or more) oligonucleotides, without limitation. Similarly, pluralities of oligonucleotides used to generate nucleic acid structures may comprise as few as 4 different types of oligonucleotides (as defined by nucleotide sequence) and as many as 1000 (or more) different oligonucleotide species (as defined by nucleotide sequence), without limitation. Thus, depending on the embodiment, the nucleic acid structure may comprise 4, 5, 6, 7, 8, 9, 10, 15, 10, 25, 50, 75, 100, 150, 200, 250, 300, 350, 400, 450, 500, 600, 700, 800, 900, 1000, 1100, 1200, 1300, 1400, 1500, or more oligonucleotides. Similarly, depending on the embodiment, a plurality of oligonucleotides used to generate nucleic acid structures may comprise 4, 5, 6, 7, 8, 9, 10, 15, 10, 25, 50, 75, 100, 150, 200, 250, 300, 350, 400, 450, 500, 600, 700, 800, 900, 1000, 1100, 1200, 1300, 1400, 1500, or more different oligonucleotides.

A variety of oligonucleotide sequences are provided herewith in the attached and incorporated appendix. The appendix illustrates the oligonucleotides required to form 3D canvases of various shapes and sizes, as described herein.

Oligonucleotides, in the context of the invention, include DNA such as D-form DNA and L-form DNA and RNA, as well as various modifications thereof. Modifications include base modifications, sugar modifications, and backbone modifications. Non-limiting examples of these are provided below.

Non-limiting examples of DNA variants that may be used in the invention are L-DNA (the backbone enantiomer of DNA, known in the literature), peptide nucleic acids (PNA) bisPNA clamp, a pseudocomplementary PNA, a locked nucleic acid (LNA), or co-nucleic acids of the above such as DNA-LNA co-nucleic acids. It is to be understood that the oligonucleotides used in products and methods of the invention may be homogeneous or heterogeneous in nature. As an example, they may be completely DNA in nature or they may be comprised of DNA and non-DNA (e.g., LNA) monomers or sequences. Thus, any combination of nucleic acid elements may be used. The oligonucleotide modification may render the oligonucleotide more stable and/or less susceptible to degradation under certain conditions. For example, in some instances, the oligonucleotides are nuclease-resistant.

The oligonucleotides may have a homogenous backbone (e.g., entirely phosphodiester or entirely phosphorothioate) or a heterogeneous (or chimeric) backbone. Phosphorothioate backbone modifications render an oligonucleotide less susceptible to nucleases and thus more stable (as compared to a native phosphodiester backbone nucleic acid) under certain conditions. Other linkages that may provide more stability to an oligonucleotide include without limitation phosphorodithioate linkages, methylphosphonate linkages, methylphosphorothioate linkages, boranophosphonate linkages, peptide linkages, alkyl linkages, dephospho type linkages, and the like. Thus, in some instances, the oligonucleotides have non-naturally occurring backbones.

Oligonucleotides may be synthesized in vitro. Methods for synthesizing nucleic acids, including automated nucleic acid synthesis, are also known in the art. Oligonucleotides having modified backbones, such as backbones comprising phosphorothioate linkages, and including those comprising chimeric modified backbones may be synthesized using automated techniques employing either phosphoramidate or H-phosphonate chemistries. (F. E. Eckstein, "Oligonucleotides and Analogues—A Practical Approach" *IRL Press*, Oxford, U K, 1991, and M. D. Matteucci and M. H. Caruthers, *Tetrahedron Lett*. 21, 719 (1980)) Aryl- and alkyl-phosphonate linkages can be made, e.g., as described in U.S. Pat. No. 4,469,863; and alkylphosphotriester linkages (in which the charged oxygen moiety is alkylated), e.g., as described in U.S. Pat. No. 5,023,243 and European Patent No. 092,574, can be prepared by automated solid phase synthesis using commercially available reagents. Methods for making other DNA backbone modifications and substitutions have been described. Uhlmann E et al. (1990) Chem Rev 90:544; Goodchild J (1990) Bioconjugate Chem 1:165; Crooke S T et al. (1996) Annu Rev Pharmacol Toxicol 36:107-129; and Hunziker J et al. (1995) Mod Synth Methods 7:331-417.

The oligonucleotides may additionally or alternatively comprise modifications in their sugars. For example, a β-ribose unit or a β-D-2'-deoxyribose unit can be replaced by a modified sugar unit, wherein the modified sugar unit is for example selected from β-D-ribose, α-D-2'-deoxyribose, L-2'-deoxyribose, 2'-F-2'-deoxyribose, arabinose, 2'-F-arabinose, 2'-O—($C_1$-$C_6$)alkyl-ribose, preferably 2'-O—($C_1$-$C_6$) alkyl-ribose is 2'-O-methylribose, 2'-O—($C_2$-$C_6$)alkenyl-ribose, 2'-[O—($C_1$-$C_6$)alkyl-O—($C_1$-$C_6$)alkyl]-ribose, 2'-$NH_2$-2'-deoxyribose, 3-D-xylo-furanose, α-arabinofuranose, 2,4-dideoxy-β-D-erythro-hexo-pyranose, and carbocyclic (described, for example, in Froehler J (1992) Am Chem Soc 114:8320) and/or open-chain sugar analogs (described, for example, in Vandendriessche et al. (1993) Tetrahedron 49:7223) and/or bicyclosugar analogs (described, for example, in Tarkov M et al. (1993) Helv Chim Acta 76:481).

The oligonucleotides may comprise modifications in their bases. Modified bases include modified cytosines (such as 5-substituted cytosines (e.g., 5-methyl-cytosine, 5-fluoro-cytosine, 5-chloro-cytosine, 5-bromo-cytosine, 5-iodo-cytosine, 5-hydroxy-cytosine, 5-hydroxymethyl-cytosine, 5-difluoromethyl-cytosine, and unsubstituted or substituted 5-alkynyl-cytosine), 6-substituted cytosines, N4-substituted cytosines (e.g., N4-ethyl-cytosine), 5-aza-cytosine, 2-mercapto-cytosine, isocytosine, pseudo-isocytosine, cytosine analogs with condensed ring systems (e.g., N,N'-propylene cytosine or phenoxazine), and uracil and its derivatives (e.g., 5-fluoro-uracil, 5-bromo-uracil, 5-bromovinyl-uracil, 4-thio-uracil, 5-hydroxy-uracil, 5-propynyl-uracil), modified guanines such as 7-deazaguanine, 7-deaza-7-substituted guanine (such as 7-deaza-7-(C2-C6)alkynylguanine), 7-deaza-8-substituted guanine, hypoxanthine, N2-substituted guanines (e.g. N2-methyl-guanine), 5-amino-3-methyl-3H,6H-thiazolo[4,5-d]pyrimidine-2,7-dione, 2,6-diaminopurine, 2-aminopurine, purine, indole, adenine, substituted adenines (e.g. N6-methyl-adenine, 8-oxo-adenine) 8-substituted guanine (e.g. 8-hydroxyguanine and 8-bromoguanine), and 6-thioguanine. The nucleic acids may comprise universal bases (e.g. 3-nitropyrrole, P-base, 4-methyl-indole, 5-nitro-indole, and K-base) and/or aromatic ring systems (e.g. fluorobenzene, difluorobenzene, benzimidazole or dichloro-benzimidazole, 1-methyl-1H-[1,2,4]triazole-3-carboxylic acid amide). A particular base pair that may be incorporated into the oligonucleotides of the invention is a dZ and dP non-standard nucleobase pair reported by Yang et al. NAR, 2006, 34(21):6095-6101. dZ, the pyrimidine analog, is 6-amino-5-nitro-3-(1'-β-D-2'-deoxyribofuranosyl)-2(1H)-pyridone, and its Watson-Crick complement dP, the purine analog, is 2-amino-8-(1'-β-D-1'-deoxyribofuranosyl)-imidazo[1,2-a]-1,3,5-triazin-4(8H)-one.

Methods of Synthesis

The invention contemplates synthesizing nucleic acid structures through annealing processes. In one approach, once the single-stranded oligonucleotides have been identified and synthesized (e.g., using commercial vendors such as Bioneer), they are combined, in a single vessel such as, but not limited to, a tube, a well, a vial, and the like. The molar amounts of oligonucleotides that are used will depend on the frequency of each oligonucleotide in the structures desired and the amount of structures desired. In some embodiments, the oligonucleotides may be present in equimolar concentrations. In some embodiments, each oligonucleotide may be present at a concentration of about 200 nM. The oligonucleotides are placed in a solution. Preferably the solution is buffered although the annealing reaction can also occur in the absence of buffer. The solution may further comprise divalent cations such as but not limited to $Mg^{2+}$. The cation or salt concentration may vary. An exemplary concentration is about 490 mM. The solution may also comprise EDTA or other nuclease inhibitors in order to prevent degradation of the oligonucleotides.

The annealing reaction is carried out by heating the solution and then allowing the solution to slowly cool down. The temperature of the reaction should be sufficiently high to melt any undesirable secondary structure such as hairpin structures and to ensure that the oligonucleotide species are not bound incorrectly to other non-complementary oligonucleotides. The temperature may therefore be initially raised to about 100° C., about 95° C., about 90° C., about 85° C., 80° C., 75° C., 70° C., 65° C. or 60° C. in some embodiments. The temperature may be raised by placing the vessel in a hot water bath or a heating block or a device capable of temperature control such as a PCR machine. The vessel may be kept in that environment for seconds or minutes. Typically, an incubation of about 1-10 minutes is sufficient.

Once the incubation at elevated temperature is complete, the temperature may be dropped in a number of ways. The temperature may be dropped in an automated manner using a computer algorithm that drops the temperature by a certain amount and maintains that temperature for a certain period of time before dropping the temperature again. Such automated methods may involve dropping the temperature by a degree in each step or by a number of degrees at each step. The vessel may thus be heated and cooled in the same device.

An exemplary process is provided. To effect a drop in temperature from about 80° C. to about 24° C., the temperature is changed from 80° C. to 61° C. in one degree increments at a rate of 3 minutes per degree (i.e., 80° C. for 3 minutes, 79° C. for 3 minutes, etc.). The temperature is then changed from 60° C. to 24° C. in one degree increments and at a rate of about 120 minutes per degree (i.e., 60° C. for 120 minutes, 59° C. for 210 minutes, etc.). The total annealing time for this process is about 17 hours. In accordance with the invention, under these conditions, the oligonucleotides self-assemble into a nucleic acid structure of predetermined and desired shape and size.

An example of a specific annealing process uses 100 200 nM oligonucleotides in a 5 mM Tris-1 mM EDTA (TE), 40 mM $MgCl_2$ solution and heating the solution to about 90° C. and then cooling the solution to about 24° C. over a period of about 73 hours, as described above with a 3 minute per degree drop between 80° C. and 61° C. and a 120 minute per degree drop between 60° C. and 24° C.

Composite Structures

The invention further contemplates that the nucleic acid structures described herein themselves may be used essentially as monomers or building blocks in order to form higher order or composite structures. The composite structures of the invention are comprised of nucleic acid structures linked to each other using spacer-linkers. The linkers are typically not integral to the nucleic acid structures although they may be attached to the structures via suitable functional groups. The ability to attach two or more nucleic acid structures together allows structures of greater size and complexity to be made.

The dimensions of these composite structures may range from 500 nm to 100 microns, or 1-1000 microns, without limitation.

Applications

The nucleic acid structures of the invention may be used in a variety of applications, including those that would benefit from the ability to precisely position and importantly arrange one or more moieties at a nanometer or micron scale.

As an example, the structures can be used as templates for arranging or patterning inorganic materials such as those useful in electronics, plasmonics, and quantum computing applications. Moieties that may be attached to the nucleic acid structures include metallic particles such as gold nanoparticles, quantum dots, carbon nanotubes, and the like. In this way, the nucleic acid structures provided by the invention act as scaffolds upon which other moieties may be arranged and/or other structures may be synthesized with nanometer precision and control. For example, carbon nanotubes can be organized into functional molecular electronics systems; tunable geometric arrangement of gold nanoparticles can be used to make functional molecular electronics circuits and novel plasmonics circuits; organized, predetermined arrangement of magnetic particles can be used to make nano-inductors or memory devices; and organized and predetermined arrangement of quantum dots can be used to make novel quantum computers.

In some embodiments, the moieties (e.g., gold nanoparticles) may be attached to nucleic acid structures of the invention through nucleotide base-pairing of complementary single-stranded oligonucleotides linked to the moieties and to the nucleic acid structure, as described, for example, in Example 5. Thus, in some embodiments, moieties such as gold nanoparticles may be arranged into discrete patterns as follows. Nucleic acid structures of the invention containing single-stranded poly-N oligonucleotide (e.g., a single-stranded poly-A oligonucleotide, or a single-stranded oligonucleotide comprising contiguous adenine nucleotides) at specific positions (e.g., within pores and/or channels) are contacted with moieties linked to (e.g., covalently, or non-covalently, attached to) a single-stranded poly-N oligonucleotide that is complementary to the single-stranded poly-N oligonucleotide of the nucleic acid structures (e.g., a single-stranded poly-T oligonucleotide, or a single-stranded oligonucleotide comprising contiguous thymidine nucleotides). In some embodiments, a single-stranded poly-N oligonucleotide is about 2 to about 15 nucleotides. In some embodiments, a single-stranded poly-N oligonucleotide is 2, 3, 4, 5, 6, 7, 8, 9, 10, 11, 12, 13, 14 or 15 nucleotides. In some embodiments, the single-stranded poly-N oligonucleotide is a single-stranded poly-A, single-stranded poly-T oligonucleotide, a single-stranded poly-G oligonucleotide, or a single-stranded poly-C oligonucleotide of about 10 nucleotides.

In other aspects, the invention contemplates that the nucleic acid structures of the invention may be metalized to make components for electronics. DNA tubes have been metalized into nanowires. Controlled metallization of the nucleic acid structures of the invention can be used to make, among other things, nano-wires with controlled diameters and hence controlled electronic properties. Further, novel molecular electronic components and circuits can be made through controlled metallization of the strut based nucleic acid structures provided by the invention.

The nucleic acid structures can also be used as templates for biological or organic molecules. Such templated molecules and systems may be useful, for example, in diagnostic and research applications. The biological or organic molecules include without limitation proteins and peptides such as antibodies and antibody fragments, enzymes and enzyme domains, receptors and receptor domains, biological ligands such as hormones and other signaling moieties, polysaccharides, cells, cell aggregates, and the like. Diverse strategies have been demonstrated for templating proteins on DNA lattices. Organization of proteins into prescribed geometric patterns with programmable nanometer precision can be used, for example, to study the cooperative behavior of biological motor proteins. Certain nucleic acid structures may also be used in cell or tissue culture. In these embodiments, as an example, the structures may be functionalized with biological moieties such as growth factors and extracellular matrix components. In this way, the functionalized structures may be arranged in culture to mimic a two or three-dimensional in vivo environment. As a further example, it is contemplated that higher order functionalize structures may be made that exhibit a concentration gradient for any particular biological moiety. These systems can then be used to study cellular development, differentiation and/or motion for any number of cell types. In still other instances, higher order structures of the invention can be used as scaffolds for cellular growth and differentiation in vitro or in vivo.

In various of these applications, the invention further contemplates that the nucleic acid scaffold comprised of the structures of the invention may be retained or it may be removed (e.g., through digestion or degradation) once it ceased being a template. For example, if the goal is to create a predetermined arrangement of gold particles and such particles are connect to each other as desired independently of the nucleic acid scaffold, the scaffold may be removed, leaving only the gold nanoparticle network.

Algorithms, Programs and Computer Systems

The invention contemplates algorithms for generating 3D nucleic acid structures of particular shape and size. These algorithms involve a starting point of a 3D canvas of sufficient size, wherein the oligonucleotides and domains contributing to any location in the canvas are known. The end user then defines within the canvas the desired structure and the algorithm identifies which oligonucleotides are to be included, which are to be excluded, and which are to be replaced in the generation of such a structure. Exemplary algorithm steps are shown in programs 1, 2 and 3 in FIG. 17. The invention contemplates that such algorithms may be performed manually or by computer means.

An illustrative implementation of a computer system that may be used in connection with some embodiments of the invention may include one or more processors and one or more computer-readable non-transitory storage media (e.g., memory and one or more non-volatile storage media). The processor may control writing data to and reading data from the memory and the non-volatile storage device in any suitable manner, as the aspects of the present invention described herein are not limited in this respect. To perform any of the functionality described herein, the processor may execute one or more instructions stored in one or more computer-readable storage media (e.g., the memory), which may serve as non-transitory computer-readable storage media storing instructions for execution by the processor.

Certain above-described embodiments of the present invention can be implemented in any of numerous ways. For example, the embodiments may be implemented using hardware, software or a combination thereof. When implemented in software, the software code can be executed on any suitable processor or collection of processors, whether provided in a single computer or distributed among multiple computers. It should be appreciated that any component or collection of components that perform the functions described above can be generically considered as one or more controllers that control the above-discussed functions. The one or more controllers can be implemented in numerous ways, such as with dedicated hardware, or with general purpose hardware (e.g., one or more processors) that is programmed using microcode or software to perform the functions recited above.

In this respect, it should be appreciated that one implementation of the embodiments of the present invention comprises at least one non-transitory computer-readable storage medium (e.g., a computer memory, a floppy disk, a compact disk, a tape, etc.) encoded with a computer program (e.g., a plurality of instructions), which, when executed on a processor, performs the above-discussed functions of the embodiments of the present invention. The computer-readable storage medium can be transportable such that the program stored thereon can be loaded onto any computer resource to implement the aspects of the present invention discussed herein. In addition, it should be appreciated that the reference to a computer program which, when executed, performs the above-discussed functions, is not limited to an application program running on a host computer. Rather, the term computer program is used herein in a generic sense to reference any type of computer code (e.g., software or microcode) that can be employed to program a processor to implement the above-discussed aspects of the present invention.

The following Examples are included for purposes of illustration and are not intended to limit the scope of the invention.

EXAMPLES

Example 1. Self-Assembly of 3D DNA-Block Nanostructures Across the Scale

To better understand our method and demonstrate its capability, 3D DNA-block nanostructures of a variety of sizes and aspect ratios were designed and tested (FIG. 2).

Random Sequence Design.

Figure 8A:
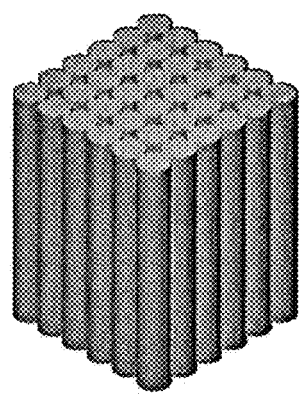
FIGS. 8A-8C show self-assembly of 6H×6H×64B cuboid with random sequence and designed sequence.
Figure 8B:
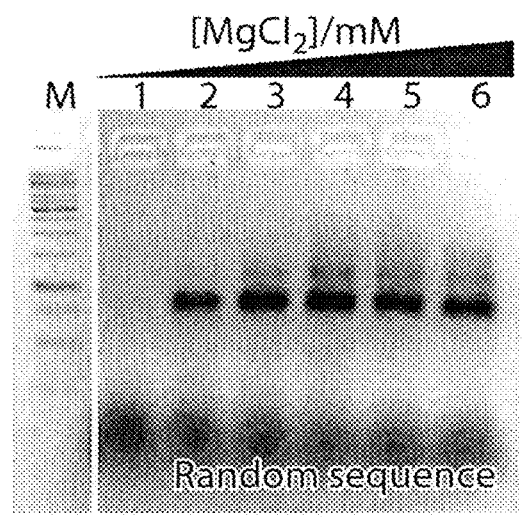
Figure 8C:
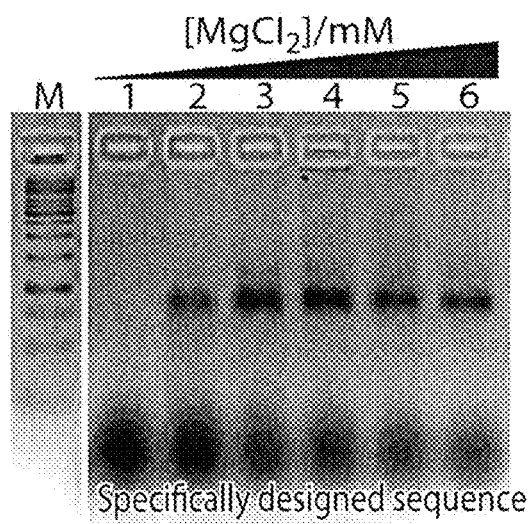

The sequences of oligonucleotides (also referred to as "DNA bricks") were designed by random assignments of base pairs (A-T, G-C) to 3D nanostructures. We first tested two versions of 6H×6H×64B with either random sequences or specially designed sequences and observed comparable self-assembly results (FIG. 8). We also tested three sets of random sequences on a 4H×12H×120B and also observed similar self-assembly yields (data not shown). Based on these results, we designed additional nanostructures using random sequences. The sequences were generated by a combination of a custom program and UNAfold, a program available at the mfold, rna, Albany website. Sequences of the first set of oligonucleotides (X-bricks) were first generated by taking the following three criteria into consideration: (1) smoothing binding energy of strands (each strand has similar GC content); (2) minimizing secondary structure of each strand; and (3) reducing sequence symmetry. The second set of oligonucleotides (Y-bricks) was then generated according to their complementarity to the first set. The product yields for structures assembled using random sequences and specifically designed sequences were similar. While the random sequence design strategy is used herein for synthesis of most nanostructures, the sequence design strategy may also be used and is being explored in ongoing studies.

Protector DNA Bricks.

Including unpaired single-strands at the ends of DNA duplex has proven to be effective for mitigating blunt-end stacking (P. W. K. Rothemund (2006)). An unpaired single-stranded 8 nt domain protrudes from every 5' or 3' end of all DNA duplexes in a 3D nanostructure (FIGS. 1C and 1D). Sequences of these 8 nt domains can be replaced with eight contiguous thymines to prevent undesired interactions. DNA blocks with modified head or tail domains are designated "head protectors" or "tail protectors," respectively.

Boundary DNA Bricks.

Figure 9A:
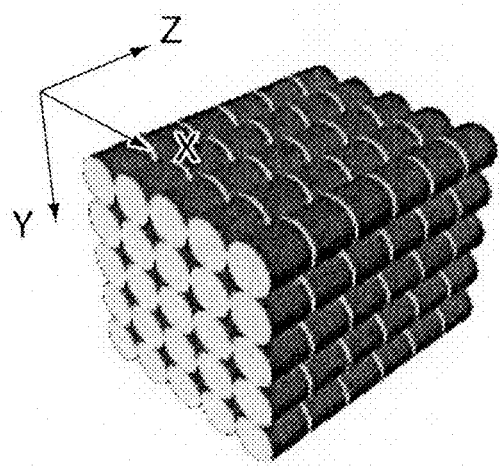
FIGS. 9A-9C show a 48 nucleotide boundary strand design.
Figure 9B:
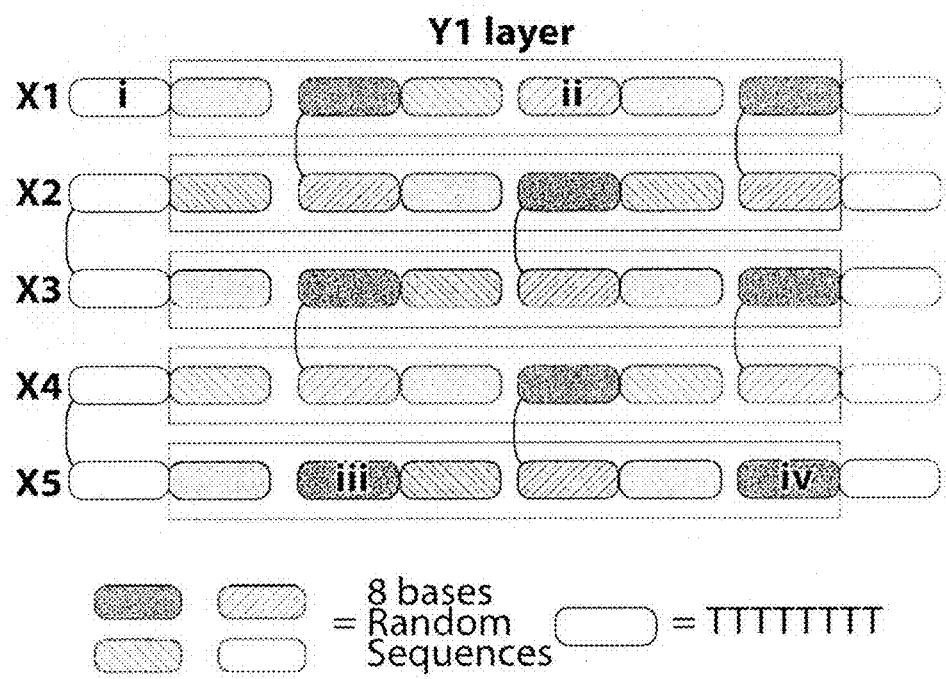
Figure 9C:
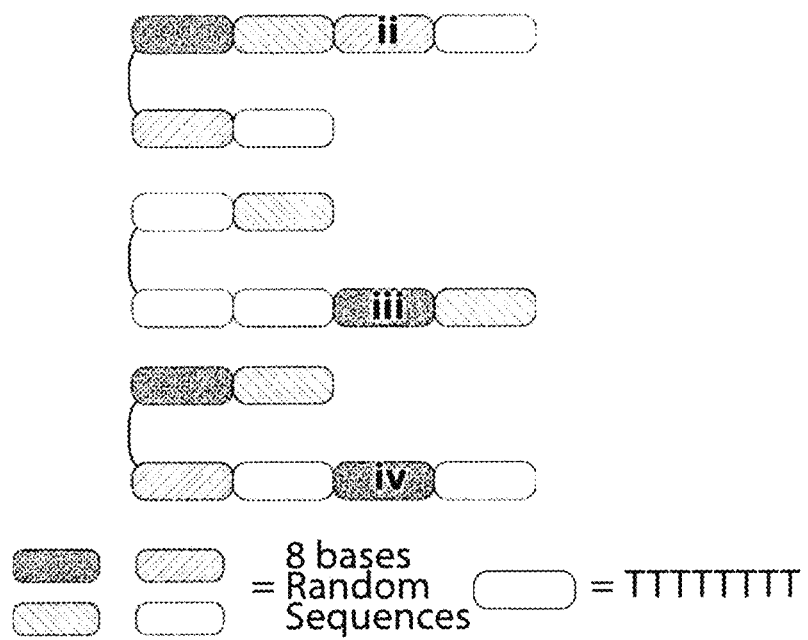
Figure 10A:
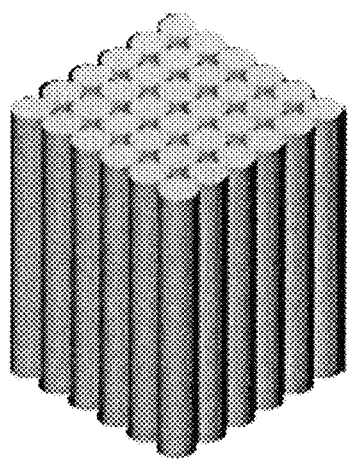
FIGS. 10A-10C show self-assembly of a 6H×6H×64B cuboid with 48 nucleotide boundary strand and without boundary strand.
Figure 10B:
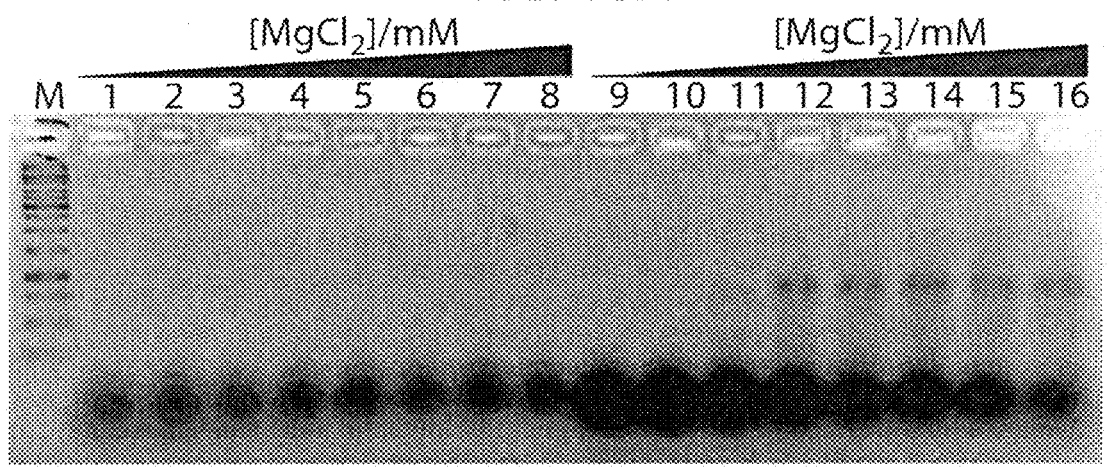
Figure 10C:
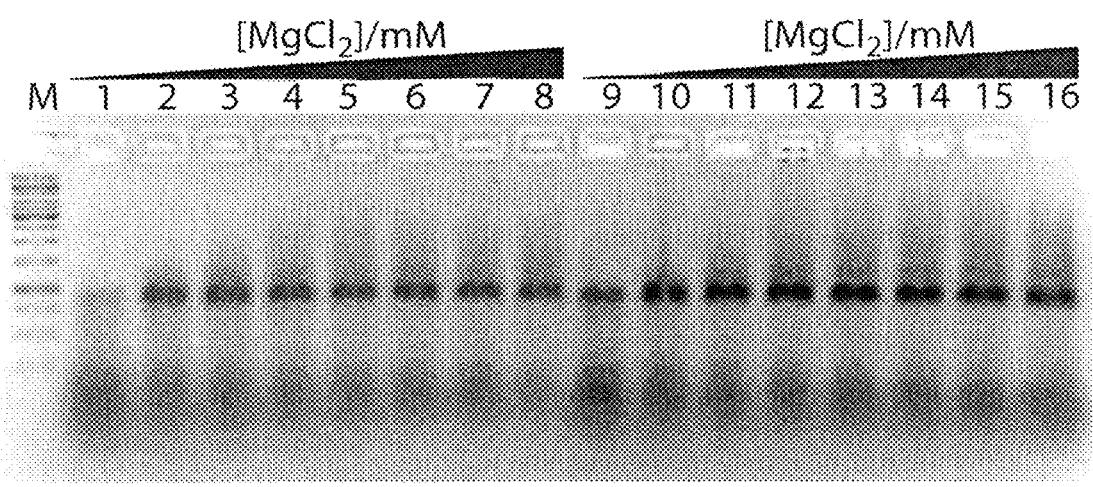

16 nt half-brick can be merged with a 32 nt full-brick that precedes along the direction of its helix, forming a 48 nt long boundary strand (FIGS. 9 and 10). We observed significant improvement of self-assembly for a 6H×6H×64B when the long boundary design was implemented, perhaps due to accelerated nucleation of target nanostructure formation. Hence, this merge strategy was applied to all 3D nanostructures.

Characterization of 6H×10H×128B.

Figure 11:
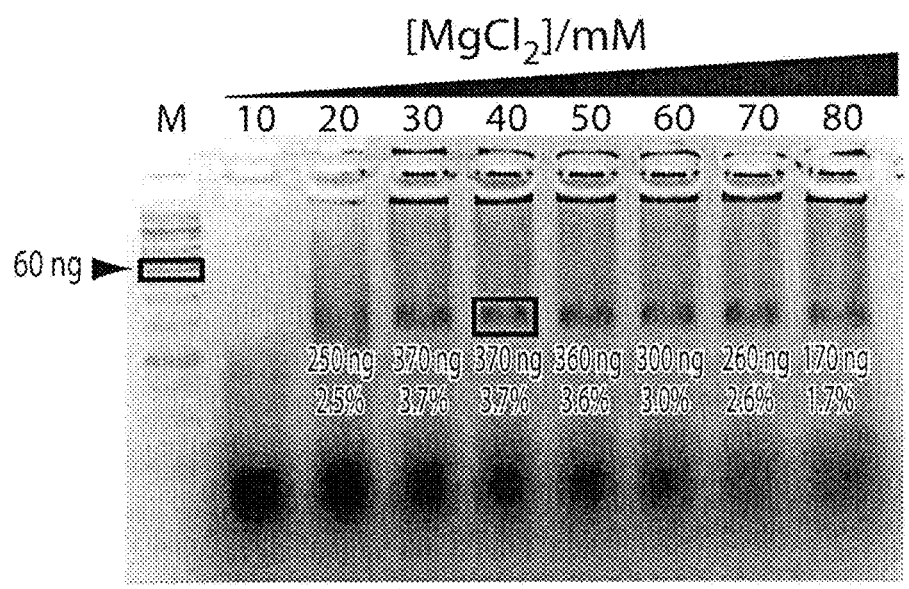
FIG. 11 shows yield analysis of a 6H×10H×128B structure based on agarose gel electrophoresis. 200 nM of each strand was self-assembled with a 72-hour annealing protocol and in 0.5×Tris buffer with 10, 20, 30, 40, 50, 60, 70, 80 mM MgCl$_2$, using a 72-hour annealing ramp. A 10 μL sample was loaded into each lane. Lane M shows the 1 kb ladder. The band in the light gray box on the left indicates the 3000 bp ladder band corresponding to 60 ng DNA. This band was used as a standard to measure the yield of products. Product band formed at 40 mM MgCl$_2$ is marked within a box. Below each product band, both the absolute mass value and percentage yield of the product band are shown.

We first constructed a 6H×10H×128B cuboid that consists of 459 strands (7680 bp, similar in size to an M13-based DNA origami, see FIGS. S11, S12 for design details). Unpurified DNA strands were mixed together at nominally equal ratios without careful adjustment of stoichiometry. To determine optimal annealing conditions, we tested two annealing ramps (24-hour annealing and 72-hour annealing), two strand concentrations (100 nM and 200 nM per strand), and eight MgCl$_2$ concentrations (10, 20, 30, 40, 50, 60, 70, 80 mM) for 6H×10H×128B self-assembly. Equal amounts of each samples (2 pmol per strand) were then subjected to ethidium bromide (EtBr)-stained 2% agarose gel electrophoresis (FIGS. 2B, 2C). The yields of 3D nanostructures were estimated using agarose gel electrophoresis. FIG. 11 demonstrates one example of such assays. Annealed samples were subjected to agarose gel electrophoresis to separate the product from free strands and unwanted aggregates. The yield of a product was estimated by comparing the fluorescence intensity of product band (marked in a black box) to the fluorescence intensity of the 3 k bp ladder band (marked in a gray box). Both fluorescence intensities were first subtracted by background noise, and then used for calculation. The intensities were measured using ImageJ software:

$$\text{Product mass} = \frac{\text{Fluorescence intensity of product band}}{\text{Fluorescence intensity of 3 kb ladder}} \times 60 \text{ ng}$$

Percentage yield is then calculated as:

$$\text{Percentage yield} = \frac{\text{Mass of product}}{\text{Mass of all strands}}$$

The efficiency of the EtBr staining may vary between the double-stranded 3 kbp ladder and our 3D structures. Therefore the absolute numbers of yield might vary. Nonetheless, this assay is especially useful for comparing self-assembly results between nanostructures and for screening optimal annealing conditions of 3D structures. Maximum yield (370 ng, or about 4%) was achieved at the following conditions: 200 nM per strand, 72-hour annealing, 40 mM MgCl$_2$. This yield is comparable to the previously reported 4% to 14% yield of 3D DNA origami of similar size and aspect ratio (a 10H×6H, an 8H×8H, a 6H×10H, and a 4H×16H) (S. Douglas, et al., Nucleic Acids Research 37, 5001 (2009)). It is worth noticing that the origami The origami yield is estimated as $$\text{Yield} = \frac{\text{Scaffold strands incorporated into product}}{\text{Total scaffold strands}}.$$

The loss of excessive staple strands (normally 5 to 10 fold more than the scaffold strand) is not taken into account. The optimal 40 mM MgCl$_2$ used herein is higher than the optimal 30 mM (or below) MgCl$_2$ concentration for 3D origami folding (S. M. Douglas, et al., Nature 459, 414 (2009)). Column-purified product (~50% recovery efficiency (FIG. 2D)) migrated as a single band by agarose gel electrophoresis and appeared under transmission electron microscopy (TEM) with expected morphology and measured dimensions of 0.34 nm (±0.01 nm SD) per base pair height and 2.5 nm (±0.2 nm SD) per helix width. After agarose gel purification of 6H×10H128B, yield was also calculated by counting the structures in the TEM images. This "TEM yield" is related to the stability of purified structures. The particles in TEM images were categorized as "good," "minor defect," or "major defect," depending upon the amount and degree of defects present. Final yields were determined by counting percentage of the good particle out of the total particles. Most minor defects occur at the locations close to the helix ends of structures, possibly indicating that strands are prone to dissociation at these locations. Additionally, these yields are generally indicative of the stability of the particles. It is worth noting that imaging bias the may affect accuracy of the measurements. An estimated 55% TEM yield was obtained by counting the percentage of intact particles in TEM images (FIG. 12). This TEM yield is comparable to the previously reported yields of 3D square-lattice DNA origami (27% yield for a 6H×12H×80B, 59% for an 8H×8H×96B) (Y. Ke, et al., *J. Am. Chem. Soc* 131, 15903 (2009)).

Figure 13A:
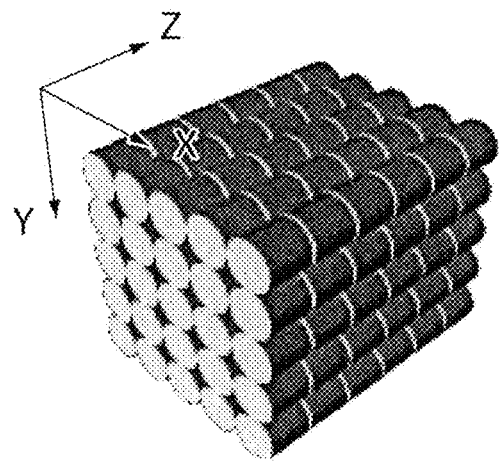
FIGS. 13A-13C show the design strategy for modified 3D structures.
Figure 13B:
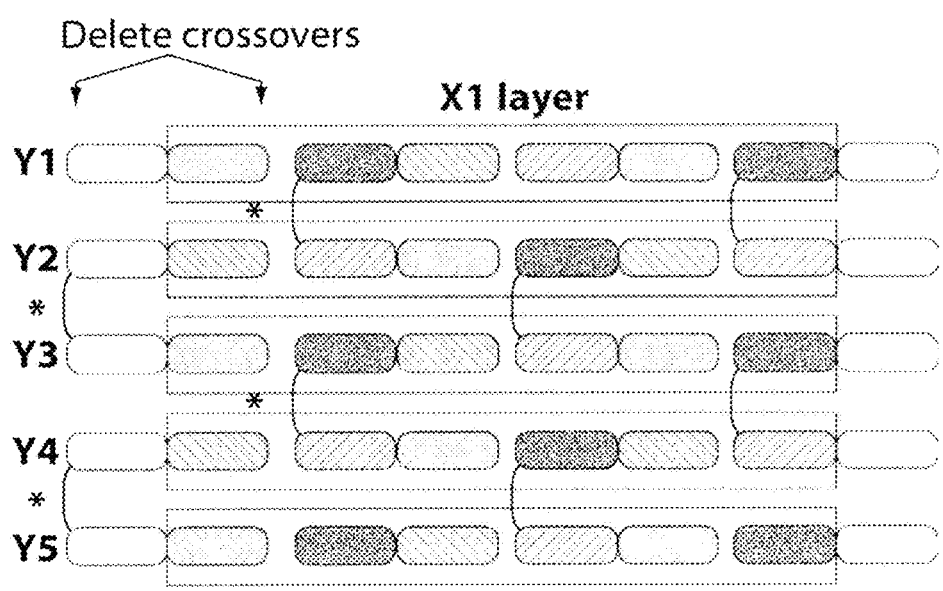
Figure 13C:
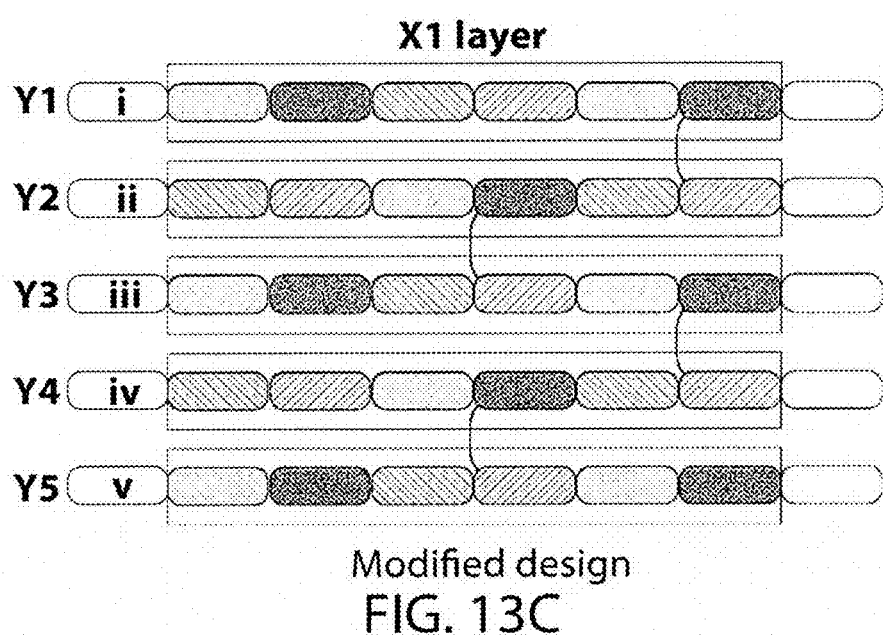
Figure 14A:
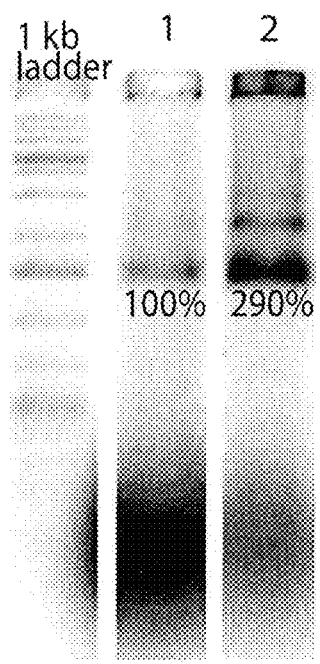
FIGS. 14A and 14B show agarose gel and TEM yields of 6H×10H×128B-M structures.
Figure 14B:
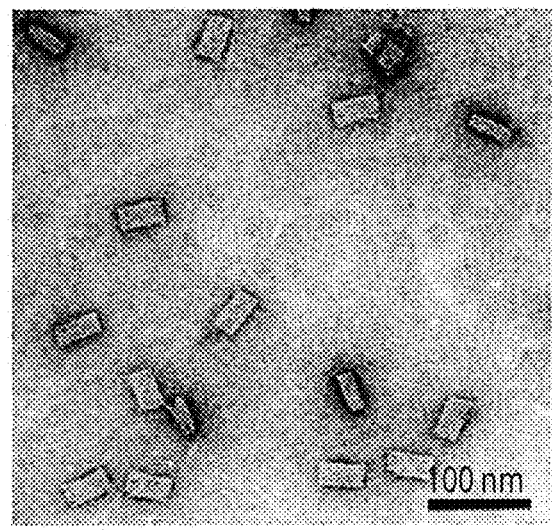

Strands that are located at the either ends of the DNA duplexes have only one or two 8 nt random-sequence segments, which are used to base-pair with other strands (FIG. 13B). Thus a reasonable assumption is that these "head" or "tail" strands are less likely to incorporate during the annealing and more prone to dissociation from an 3D structure after annealing, compared to strands that are located more deeply within a structure. It is conceivable that design strategies that increase the incorporation efficiency of these "head" or "tail" strands will favor the overall self-assembly quality of 3D structures. We tested this hypothesis with a modified design (FIG. 13C) to improve the incorporation efficiency of "head" strands. A similar modification can be applied to the "tail" strands as well. The design method includes two steps. (1) Deletion of crossovers: as indicated by the arrows (FIG. 13B), the first and second column of crossovers are removed. (2) Connection of strands: as shown in FIG. 13C, each pair of strands that are in the same duplex are merged together to form a longer single strand. These new strands are either 32 nt long with three random-sequence domains, or 48 nt long (boundary strand) with five random-sequence domains. By redesigning "head protectors" of 6H×10H×128B to merge them with their neighboring strands (FIG. 13), a modified version 6H×10H×128B-M showed 190% improvement of yield and 17% improvement of TEM yield, over the 6H×10H×128B (FIG. 14). Although the modification of "head" strands are expected to improve the self-assembly of SSD 3D structures, the deletion results in a lower crossover density that can create local deformation, especially for structures with shorter helices. Therefore, we only tried this modified version as a proof-of-concept that 3D structures can be stabilized by implementing special design rules. Other 3D structures used herein were designed using the original strategy. Other approaches, such as cross-linking (A. Rajendran, et al. *J. Am. Chem. Soc.* 133, 14488 (2011)), may prove to be more general methods for stabilizing 3D DNA nanostructures without sacrificing design flexibility.

Nanostructures of Different Sizes.

Figure 15A:
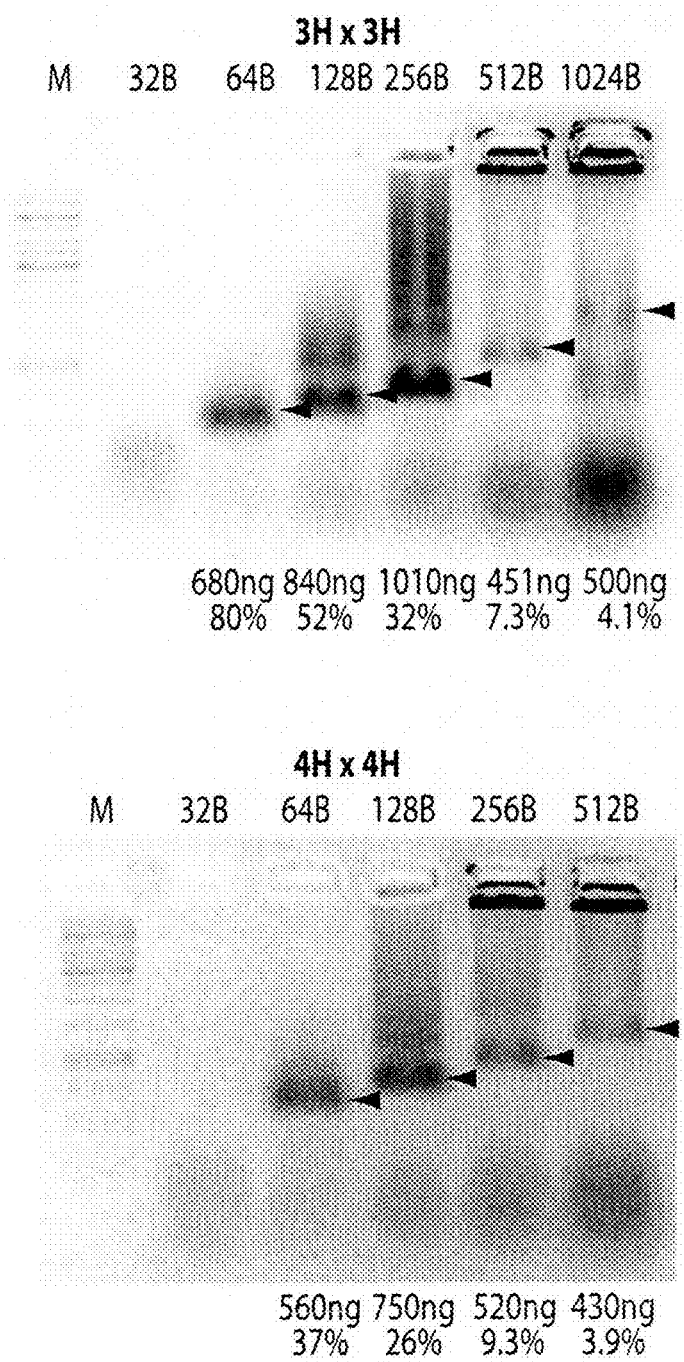
FIGS. 15A-15B show agarose gel yield analysis of 3H×3H, 4H×4H, 6H×6H, 6H×10H, and 8H×12H structures. The structures were self-assembled in 0.5×Tris buffer with 40 mM MgCl$_2$ using 72-hour annealing ramp. The concentration of each strand was 200 nM. A 10 μL sample was loaded into each lane. Lane M shows a 1 kb ladder. The 3000 base pair band corresponding to 60 ng of DNA was used as a standard to measure the yield of annealing products, which is indicated by the arrow. Below each product band, both the absolute mass value and percentage yield of the product band are shown.
Figure 15B:
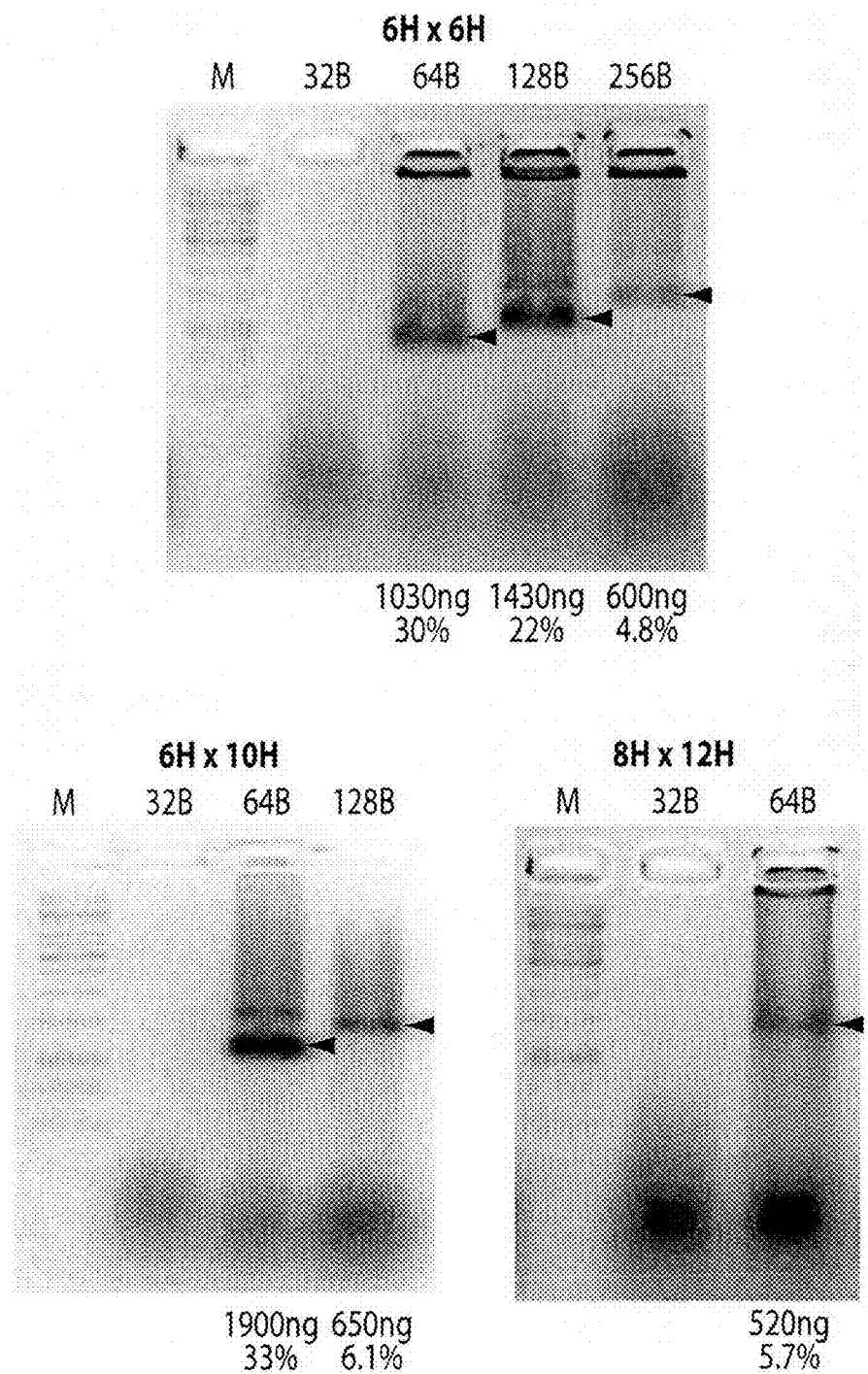

Six groups of nanostructures that contains 9 helices, 16 helices, 36 helices, 60 helices, 96 helices, and 144 helices were designed, then annealed using the optimal conditions previously identified for 6H×10H×128B self-assembly (data not shown). We observed correct product bands (FIGS. 2G and 15A-15B) for all designs except for those that are 32 bp in length (and that therefore contain one crossover between each pair of neighboring helices). Yields vary from lower than 1% to about 80% (FIGS. 15A-15B). Smaller designs exhibit higher percentage yields within each group, except for those that are 32 bp in length. The highest yield of all designs (80%) was observed for the smallest object 3H×3H×64B (1,296 nt or about 0.43 MDa). Lowest yields were observed for 8H×12H×120B, 4H×24H×120B, and 12H×12H×48B whose yields were too low (below 1%) to be measured accurately. Measured dimensions of intact particles for each nanostrutures are in agreement with our designs, suggesting 3D self-assembly of different sizes is successful (Table 1). The largest DNA structures assembled were 8H×12H×120B (formed by 728 strands) and 4H×24H×120B (formed by 710 strands), which were identical in molecular weight (24,576 nt, or about 8 MDa, 60% more massive than an M13-based DNA origami).

Example 2. Intricate Shapes Made from a 3D 10×10×10 Voxel Canvas

It is to be understood that based on the teachings provided herein, various canvases (and then structures) may be generated using the methods described herein. Accordingly this exemplification of one particular canvas is non-limiting.

The modularity of our approach is demonstrated via successful construction and characterization of 102 shapes made from a 10H×10H×80B cuboid (10×10×10 voxel) 3D canvas. (FIG. 3A and FIG. 16). Each voxel corresponds to an 8 bp (2.5 nm×2.5 nm×2.7 nm) formed by interaction of a pair of X and Y blocks.

TABLE 1

Statistics of 3H × 3H, 4H × 4H, 6H × 6H, 6H × 10H, 8H × 12H, 4H × 24H, 12H × 12H

| Nanostructure | 3H × 3H × 64B | 3H × 3H × 128B | 3H × 3H × 256B | 3H × 3H × 512B | 3H × 3H × 1024B |
|---|---|---|---|---|---|
| Number of strands | 33 | 57 | 105 | 201 | 393 |
| Number of nucleotides | 1296 | 2448 | 4752 | 9360 | 18576 |
| Measured X or Y dimension (nm) | 9 ± 0.3 | 9 ± 0.2 | 8 ± 0.2 | 8 ± 0.3 | 8 ± 0.4 |
| Measured Z dimension (nm) | 24 ± 0.4 | 45 ± 0.8 | 86 ± 1.2 | 170 ± 2 | 240 ± 10 |
| Agarose gel yield | 80% | 52% | 32% | 7.30% | 4.10% |

| Nanostructure | 4H × 4H × 64B | 4H × 4H × 128B | 4H × 4H × 256B | 4H × 4H × 512B |
|---|---|---|---|---|
| Number of strands | 62 | 110 | 206 | 398 |
| Number of nucleotides | 2304 | 4352 | 8448 | 16640 |
| Measured X or Y dimension (nm) | 11 ± 0.4 | 10 ± 0.4 | 11 ± 0.5 | 9 ± 0.3 |
| Measured Z dimension (nm) | 22 ± 0.3 | 46 ± 0.6 | 84 ± 1.1 | 170 ± 3 |
| Agarose gel yield | 37% | 26% | 9.30% | 3.90% |

TABLE 1-continued

Statistics of 3H × 3H, 4H × 4H, 6H × 6H, 6H × 10H, 8H × 12H, 4H × 24H, 12H × 12H

| Nanostructure | 6H × 6H × 64B | 6H × 6H × 128B | 6H × 6H × 256B | 12H × 12H × 48B |
|---|---|---|---|---|
| Number of strands | 147 | 267 | 507 | 486 |
| Number of nucleotides | 5,184 | 9,792 | 19,008 | 16128 |
| Measured X or Y dimension (nm) | 15 ± 0.7 | 16 ± 0.6 | 15 ± 0.6 | 31 ± 1.2 |
| Measured Z dimension (nm) | 22 ± 0.4 | 43 ± 0.8 | 86 ± 1.0 | 16 ± 0.2 |
| Agarose gel yield | 30% | 22% | 4.80% | N/A |

| Nanostructure | 6H × 10H × 64B | 6H × 10H × 128B | 8H × 12H × 64B | 8H × 12H × 120B | 4H × 24H × 120B |
|---|---|---|---|---|---|
| Number of strands | 251 | 459 | 408 | 728 | 710 |
| Number of nucleotides | 8640 | 16320 | 13824 | 24576 | 24576 |
| Measured X dimension (nm) | 16 ± 0.5 | 15 ± 0.6 | 22 ± 0.8 | 21 ± 0.7 | 11 ± 0.3 |
| Measured Y dimension (nm) | 24 ± 1.2 | 26 ± 1.0 | 29 ± 1.3 | 30 ± 1.4 | 57 ± 2.6 |
| Measured Z dimension (nm) | 22 ± 0.3 | 44 ± 0.7 | 22 ± 0.3 | 41 ± 0.6 | 41 ± 0.6 |
| Agarose gel yield | 33% | 6.1 | 5.7 | N/A | N/A |

DNA Bricks and Derivatives.

Any DNA brick in the 3D canvas can become either a boundary brick (i.e. exposed at the edges of a layer) or a protector brick (i.e. in the first or last layer), even both at same time, in an custom shape design. Thus, modified versions of each brick were generated with all combinations of domain-deletion (e.g., bisect to a half-brick), polythymidine-sequence-substitution (e.g., change to protector bricks), and boundary-brick-merger (e.g., change to 48 nt boundary bricks) to accommodate all possibilities (FIG. 16). Overall, 4455 strands (total 138,240 nt) were generated by a computer program, to guarantee that any shape can be assembled with head/tail protector and bricks long boundary bricks. Exemplary sequences are provided in the attached appendix submitted herewith and to be considered part of this disclosure.

Design Process.

Figure 17:
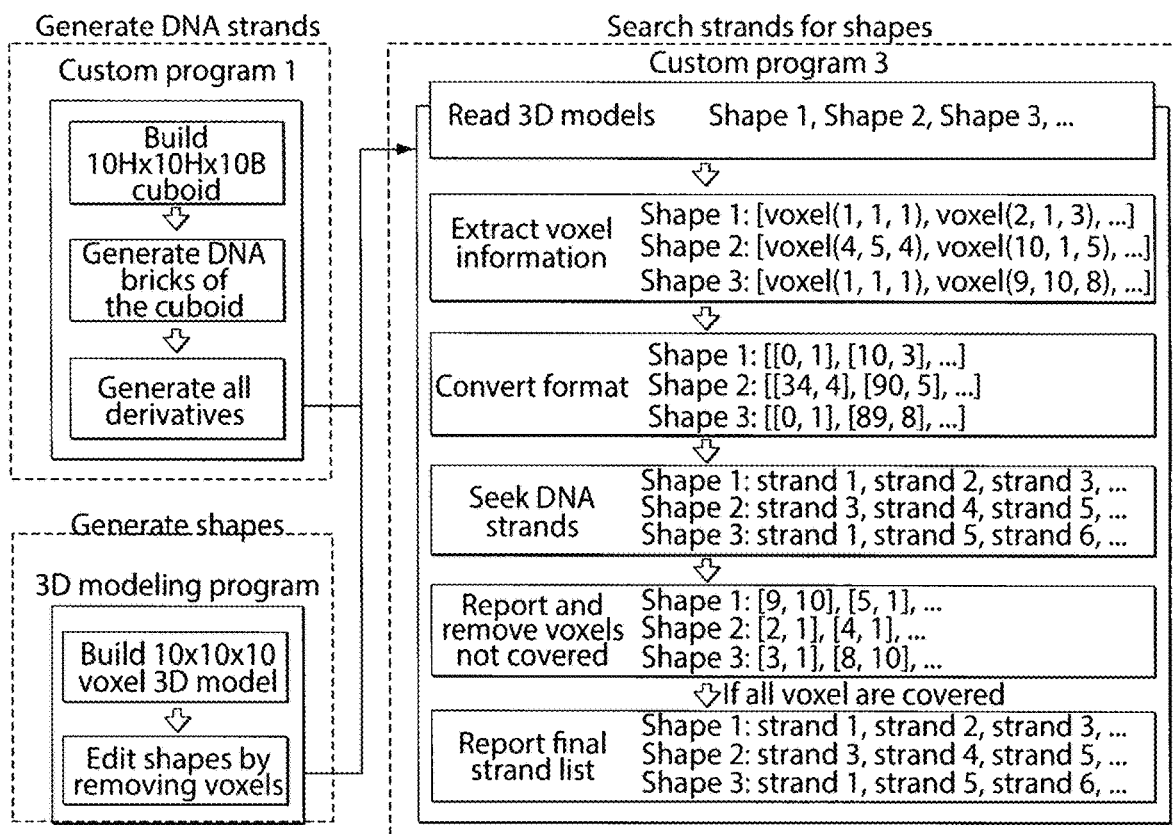
FIG. 17 shows a workflow diagram for designing 3D shapes.
Figure 18A:
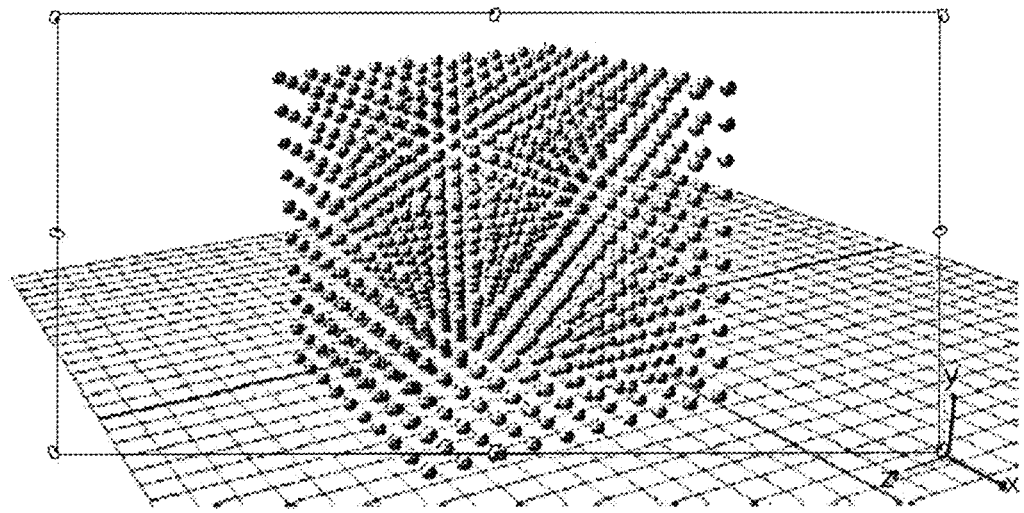
FIGS. 18A-18C show an illustration of 3D-shape-editing interface.
Figure 18B:
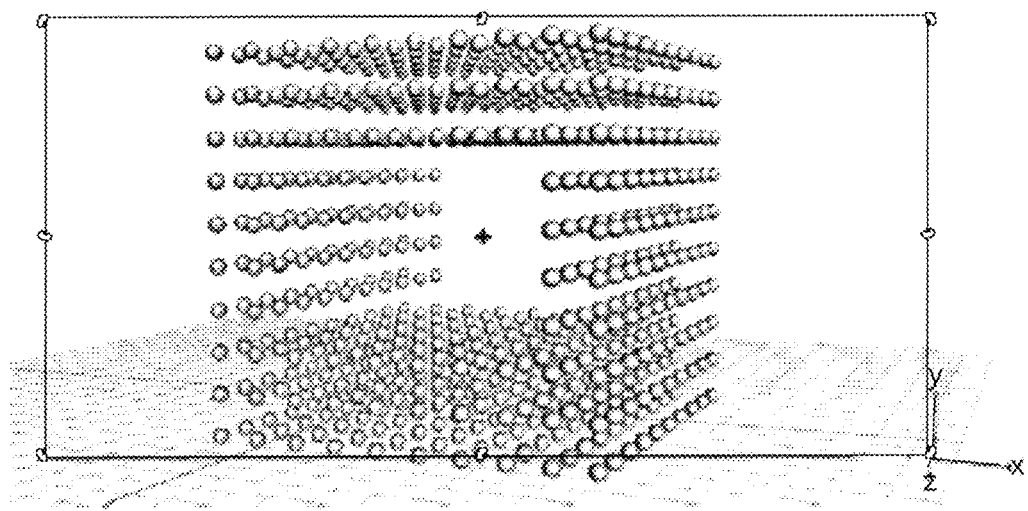
Figure 18C:
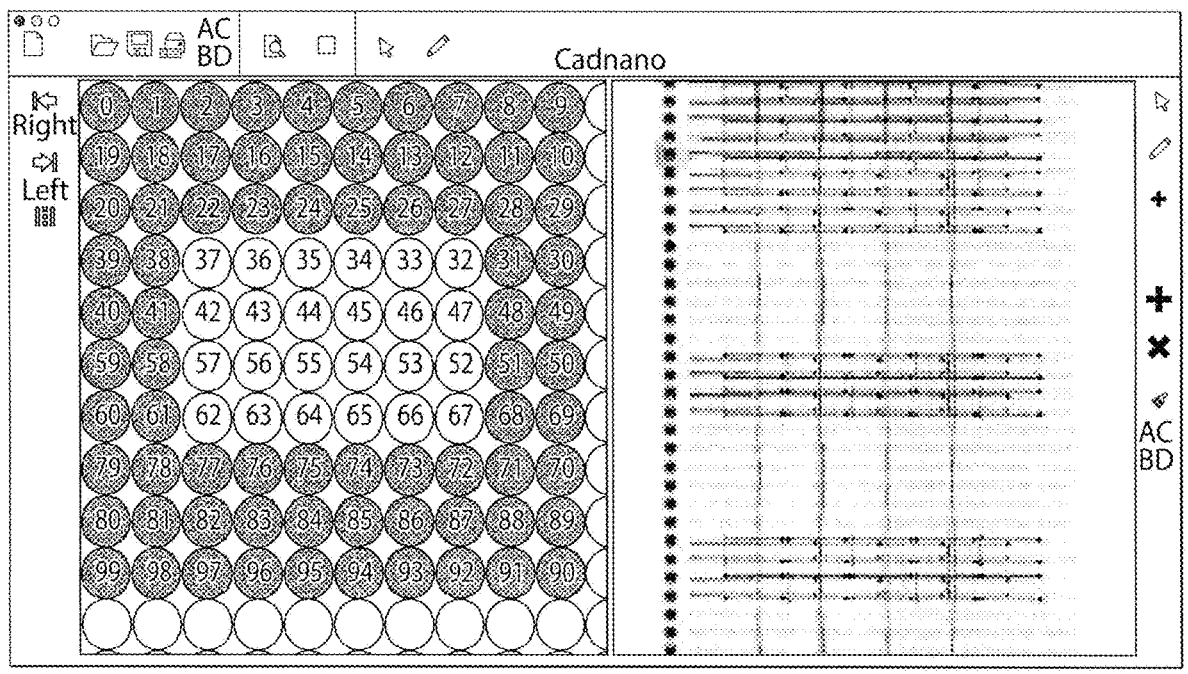

We first constructed the 10×10×10 voxel 3D canvas, where each XYZ voxel (where Z is in the helix direction) corresponds to an 8 bp duplex (2.5 nm×2.5 nm×2.7 nm). Shape design was mediated by selecting and removing particular sets of voxels. By rendering the 3D canvas using a 3D visualization software, it was possible to edit voxels on a graphical interface to design and visualize a shape (FIG. 3B and FIG. 17) with single voxel resolution. Then the voxel information of multiple shapes were interpreted by a custom program to generate a list of strands involved in the formation of each shape. This list was subsequently processed to direct a automated liquid handling robot to select DNA strands from source plates and pipette them to the wells of a product plate, mixing strands for many shapes in a high throughput manner. The complete design workflow is shown in FIGS. 17 and 18.

Design of 3D Shapes.

FIG. 16 demonstrates the 4-domain strands and their derivatives used for making arbitrary 3D shapes. Self-assembly of discrete DNA structures is often compromised by unwanted aggregation that occurs when a structure contains (1) unpaired single stranded domains, or (2) unprotected blunt ends of DNA duplexes. Different types of strands shown in C to E are designed to avoid these two situations by changing the DNA sequence of any unpaired single-stranded domain to eight consecutive Ts. This strategy leads to the presence of fourteen total types of derivatives of strands, to cover all possibilities when one, two, or three voxels is/are nonexistent for a arbitrary shape design.

If all fifteen types of strands (A to E) are included, any arbitrary shape can be designed with 8 bp (1 voxel) resolution.

Figure 16A:
FIGS. 16A-16G show designs of strands for making complex shapes from 3D canvas.
Figure 16A:
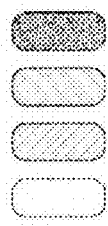
Figure 16A:
Figure 16B:
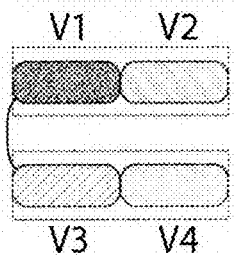
Figure 16C:
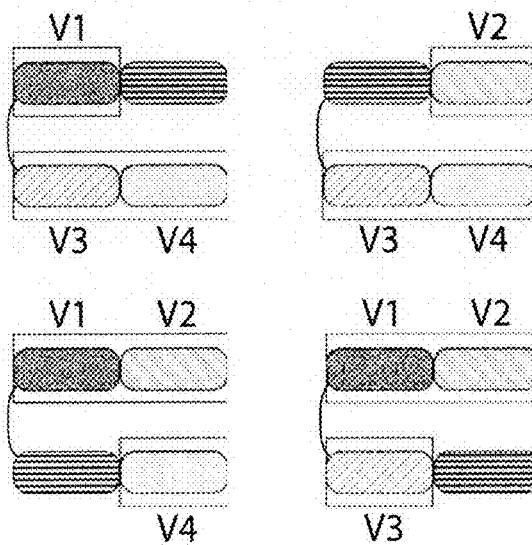
Figure 16D:
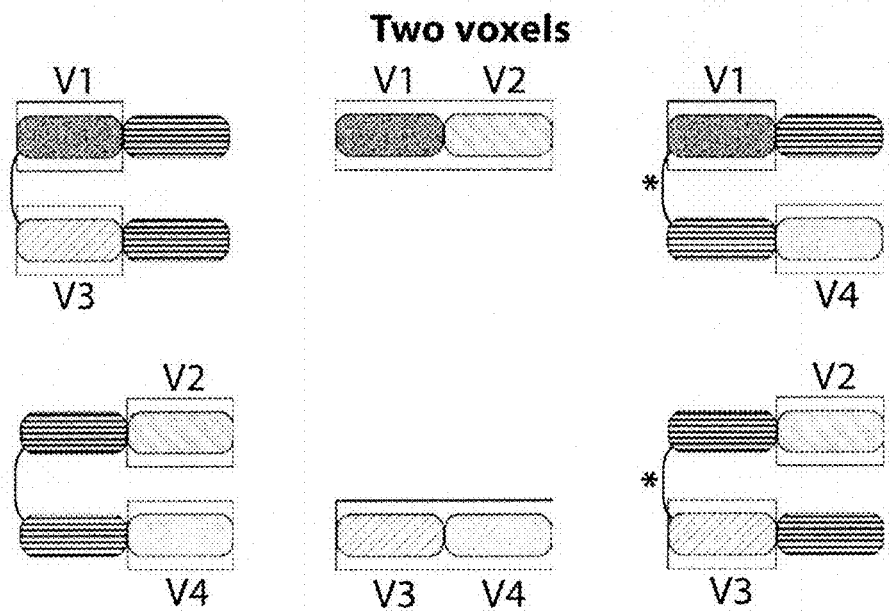
Figure 16E:
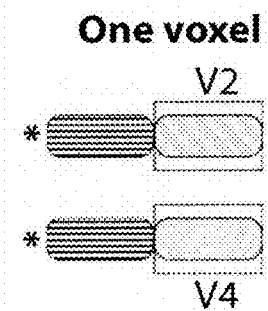
Figure 16E:
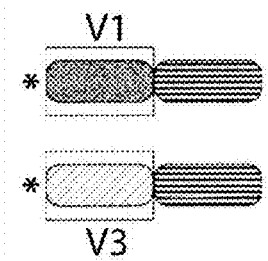

Of the fourteen derivatives of strands, only eight of them were actually implemented in the our designs and experiments. The other six derivatives (labeled with * in FIGS. 16D and 16E) types of strand are excluded. The two removed derivatives in FIG. 16D are considered to occur at low frequency for our designs of arbitrary shapes. The four removed derivatives in FIG. 16E consists of only one 8 nt random-sequence domain, so their incorporation to the DNA structures are considered less stable. We have redesigned two shapes (shape 45 and shape 55, see FIG. 3E for original shape) by incorporating more than one hundred "one voxel" derivatives for each shape. Both modified shapes failed to produce any target structures, as proven by the lack of product bands on agarose gels (data not shown). However, this simple experiment does not provide any clear indication about the incorporation efficiencies of individual "one voxel" derivatives. It is worth noting that these derivatives of strands only exist at the boundary of a shape. Exclusion of the six types of derivatives mentioned above actually appears to have little effect on the overall appearance of a shape.

We also included two types of 48 nt "boundary strands" (FIG. 10) to improve the self-assembly of the shapes. As described in the last section, each 48 nt "boundary" strand is used to substitute a 32 nt strand and a 16 nt strand. All together, for each strand, a total of (9+2)=11 original and derivatives were created for our design. Notice that strands located at the surface of a 3D canvas have fewer derivatives.

Figure 16F:
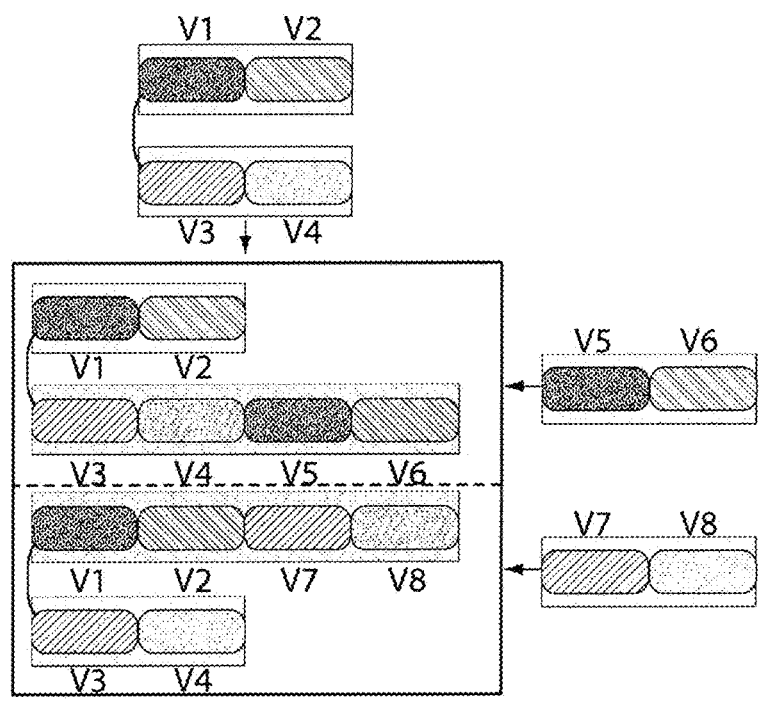
Figure 16G:
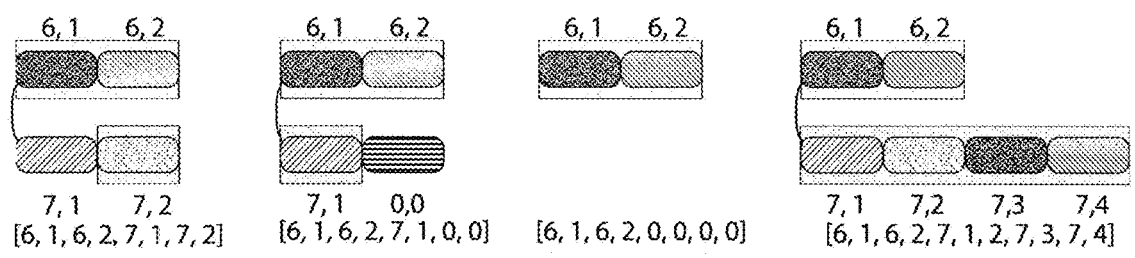

Each strand is named by the positions of the voxels it covers (FIG. 16G). Each pair of numbers represent one voxel. The first number indicates the helix and the second number indicate the voxel position on the helix. Numbers (0, 0) means a domain with eight consecutive Ts or a empty domain. The voxel information of strands is used to identify strands that can forma shape (FIG. 17).

An example of a method for designing 3D shapes is below.

Generate all DNA Strands:

(1) Build 3D canvas using a custom program (FIG. 6). We used a 10×10×10 voxel canvas herein, as an example. (2) A custom program generates strands and their derivatives (Section. S6.1.1) for self-assembly of arbitrary shapes that can be made from 10×10×10 voxel 3D canvas. All sequences and their corresponding voxel information are then stored in a single text file ALL-strand.txt. Total 4455 strands (138,240 nt) were generated for making arbitrary shapes.

Build 3D Model and Edit Shapes:

(3) Build a 3D model containing all 10×10×10 voxel using a commercial 3D modeling software (we used Strata™ 3D—at the Strata website). Each voxel is represented by a small sphere (FIG. 18A). Commercial modeling softwares provide convenient tools to remove/add voxels and visualize the shapes from different angles. (4) Design shapes by removing voxels from a 10×10×10 voxel 3D canvas, as shown in FIG. 18B. At this step, the shapes are designed with single voxel (8 bp) resolution. Each shape is stored in a single file with its voxel information.

Identify Strands for Each Shape Based on its Voxel Information:

(5) Our custom program reads out the voxel file. Based on the voxel information of the shape, the program searches the sequence file ALL-strand.txt and generates a list of strands for self-assembly of the designed shape. The program first searches for only the 32 nt and 16 nt strands to generate a shape. Then the program determines whether any pairs of 32 nt strands and 16 nt strands can be merged together to form a 48 nt "boundary" strand (FIG. 16F). If so, the program will substitute the 32 nt strand and 16 nt strand with a 48 nt "boundary" strand. (6) Because of our strand design described above, some voxel may not be covered by our strands in ALL-strand.txt. During this searching process, the program will automatically remove the voxels that cannot be covered and rerun the seeking-strand process. Notice that only a small number of voxels (on the boundary of a shape) will be removed from a shape, thus the deletions won't change the overall appearance of the shape. Note: the computer program can handle multiple shapes. So users can design all shapes first and use the computer program to generate lists of strands for all shapes at same time. (7) The program finishes searching strands, generates strand list of all shapes. It also reports voxels deleted from each shape. Users can check if there are mistakes or if too many voxels are removed. For example, the following output shows the 21 voxels removed from shape 23 (see FIG. 3E, for shapes): [[0, 1], [0, 10], [1, 10], [2, 1], [3, 10], [4, 1], [5, 10], [6, 1], [7, 10], [8, 1], [9, 10], [18, 10], [22, 10], [36, 10], [44, 10], [54, 10], [66, 10], [72, 10], [88, 10], [90, 9], [90, 10]].

Implementing this procedure, 102 distinct 3D shapes were assembled successfully (FIG. 3E). Shapes were annealed at the same annealing conditions (72-hour annealing in 0.5× TE, 40 mM $MgCl_2$ buffer) and characterized by agarose gel electrophoresis and TEM imaging (on unpurified samples).

Shape 1 to Shape 17.

The basic design constraints were studied using a group of shapes that each contains two 4H×10H×80B blocks connected by a middle two-layer "connecting block" (shape 2-17). The connecting blocks are systematically designed to possess decreasing numbers of voxels along Y-axis (shape 2-9) or Z-axis (shape 10-17). Eliminating voxels along the X axis should have the same impact as eliminating voxels along the Y-axis because of the shape symmetry. Agarose gel electrophoresis results revealed that shapes become less stable as the connecting block gets smaller for both systems (data not shown), but reducing the number of Z-axis connection appeared to have bigger effect on stability than reducing the number of Y-axis connection. Shape 9, having only a 2-voxel connection along the Y-axis, resulted in fewer than 50% broken nanostructures. In contrast, the majority of shape 17 (2 voxel along Z-axis) particles are broken, though agarose gel and TEM results do show that a small fraction of good particles were formed. Overall, these observations suggest a safe design criteria of at least two continuous X-axis or Y-axis voxels (2 helices) and three continuous Z-axis voxels (24 bp) for more stable features. However, as demonstrated in following experiments, smaller features (e.g., two continuous Z-axis voxels, shape 33 to 37) can stably exist in certain shapes where these features are presumably reinforced by voxels in close proximity.).

Solid Shape 18 to 31.

A number of solid shapes were designed including Z-direction extrusions of simple geometric shapes and more intricate objects. Formation yields and images of these objects provide more knowledge about the structural integrity of our methodology. In particular, shape 26 and 27, which both contain 3 helix thick appendages anchored only on one edge, are occasionally found without these protrusions or with them containing defects. Thus, such thin features, in spite of falling within our design criteria are less stable than more supported or thicker features.

Closed-Cavity Shape 32-42.

Previously, a few examples of 3D DNA origami with closed cavities were demonstrated, including a box (E. S. Andersen (2009)), a tetrahedron (Y. Ke (2009)), and a sphere and a ellipsoid (D. Han (2011)). Here, a series of "Empty boxes" with different sizes of cuboid cavity (shape 32 to 37) were created. Results herein also demonstrate that more complex cavity designs (e.g., square ring, cross, and triangle) are achievable (shape 38 to 42).

Open-Cavity Shape 43 to 62.

Shapes with a single cavity of varying width, depth and geometry (shape 43 to 53) and multiple-parallel cavities (shape 54 to 56) were constructed. Shapes with non-crossing perpendicular tunnels (shape 57), turning tunnels (shape 58), and crossing tunnels (shape 59 to 60) were also constructed. Furthermore, results showed the outer surface of the cuboid can be modified to create varying external views from different angles, as demonstrated by shapes 60 to 62. These shapes showcase the complexity achievable by the modular self-assembly presented herein.

Features-On-Solid-Base Shape 63 to 100.

Fine features or discrete features of 4-voxel thickness on a solid base of 10×10×6 voxel were designed. These included a full set of numerals (shape 65 to 74) and the latin alphabet (shape 75 to 100). The concentric ring structures (shape 63 and 64) showed that features as small as one voxel can be made. Such observations further show that the design criteria of 2 helix bundles by 24 bp are loosely dependent upon the surrounding environment of the structure. Because of the small number of voxel differences between the 2D features and the thickness of the solid base, the TEM images show low contrast between the two surfaces. Nonetheless, this method highlights the potential of using these 3D features to create multi-part extruded features that would otherwise be unattainable by a 2D surface.

For most shapes described herein, yields were between a few percent and 30 percent (yields of five 3D DNA origami nanostructures were reported as 7% to 44% (15)). Only five shapes had yields higher than 30 percent, and three shapes had yields lower than 1 percent. In spite of the success of making a variety of complex shapes, some shapes exhibited undesired properties. For example, complex shapes such as shape 60 to 62 showed a low percentage of intact particles in TEM images (less than 1%). Some fine features of a shape (e.g. the two wings of shapes 27) can be damaged or even totally removed if the shape is extracted from an agarose gel band. Four failed designs did not produce clear product bands on agarose gels (Fig. S55). Two other designs that had fine features on a solid base showed strong bands on agarose gels. Yet the features were unverifiable in TEM images. It is possible that self-assembly is successful for the last two shapes but the features are too small to be imaged.

Example 3. Generality of 3D DNA Modular Self-Assembly

To further explore versatility of modular DNA self-assembly, the following experiments were conducted: (1) designing of shapes with different lattice geometry, which have been demonstrated by DNA origami (P. W. K. Rothemund (2006); S. M. Douglas (2009); Y. Ke, et al. *J. Am. Chem. Soc* (2012)), and (2) testing 3D self-assembly using other types of modular DNA motifs.

Single-Layer (2D) Nanostructures.

Figure 4A:
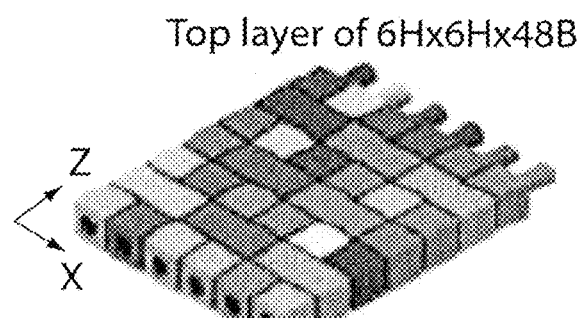
FIG. 4A is a schematic of DNA strands of the top of the 6H×6H×64B structure that is described in FIG. 1 with the crossovers to the layer below removed.
Figure 4B:
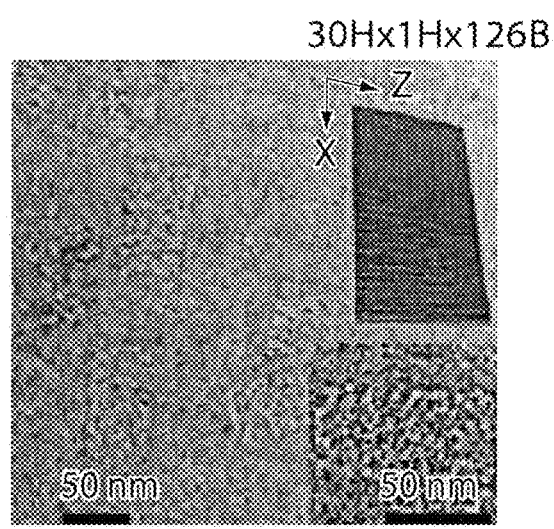
FIG. 4B shows a TEM image of a 30H×1H×126B structure. Top-right inset shows the model of the design. Bottom-right inset contains a higher magnification image of the nanostructure.
Figure 4C:
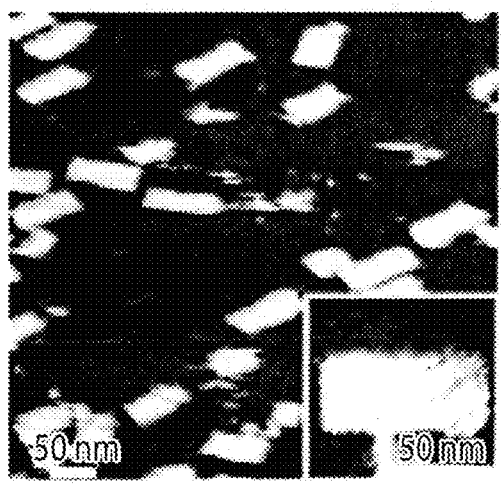
FIG. 4C shows atomic force microscopy (AFM) images of the 30H×1H×126B structure in FIG. 4B. Inset contains a higher magnification image of the structure.

Conceptually, a single layer (2D) DNA nanostructure can be constructed by "extraction" of a layer from a 3D DNA-block nanostructure (FIG. 4A). A 30H×1H×126B was tested (data not shown). It was intentionally modified to be 10.5 bp/turn instead of 10.67 bp/turn (for 3D design), in order to get a relatively flat nanostructure. Yield was estimated to be 18% based on result of agarose gel electrophoresis (data not shown). Dimensions of 30H×1H×126B were measured to be 0.31 nm (±0.01 nm SD) per bp, 2.6 nm (±0.3 nm SD) per helix, on basis of AFM images.

3D Honeycomb-Lattice Nanostructures.

Figure 4D:
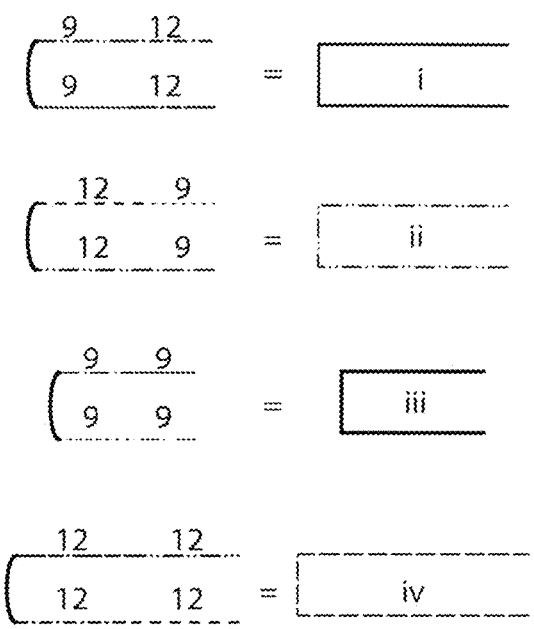
FIG. 4D is a schematic of the four types of strands designed for the formation of a honeycomb-lattice 3D DNA nanostructure.
Figure 4E:
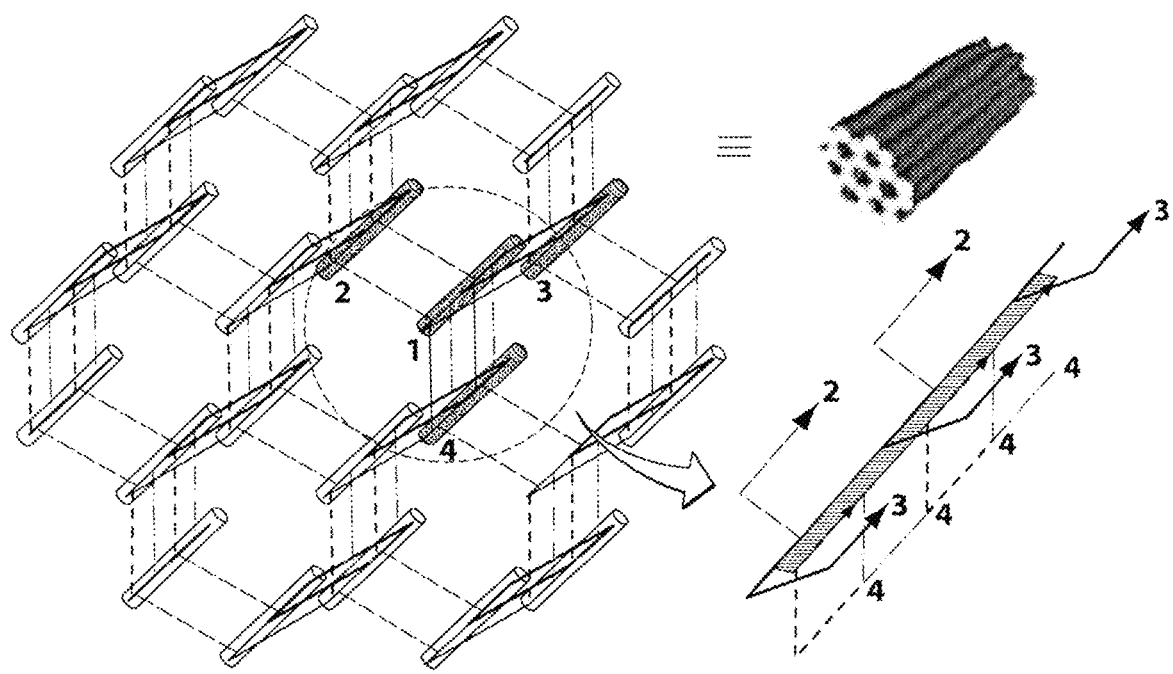
FIG. 4E is a schematic of a strand diagram of an 84 base pair 3D nanostructure. The right-bottom image depicts an enlarged image of the circled helix bundle.
Figure 4F:
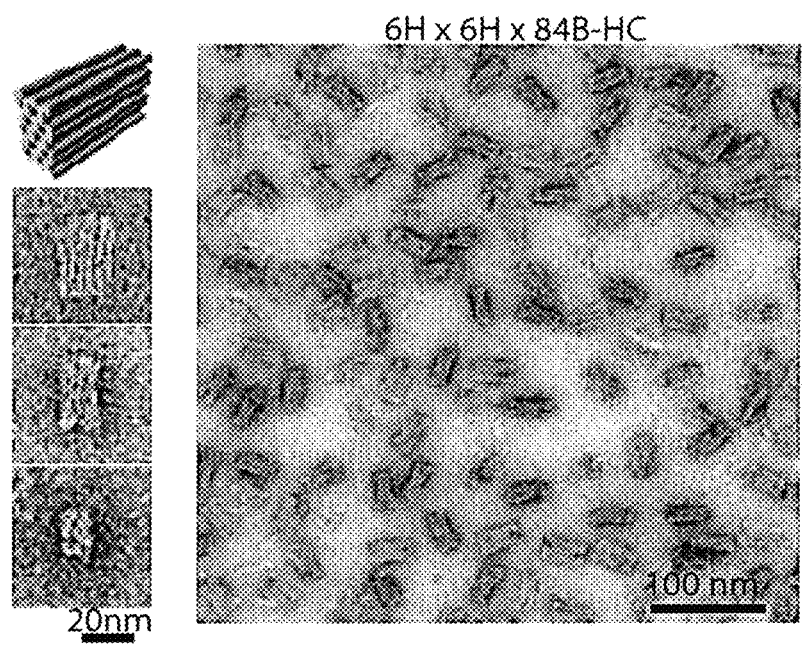
FIG. 4F shows TEM images of a 6H×6H×84B-HC (honeycomb lattice) 3D DNA nanostructure. Insets show enlarged images of different projections of the structures/particles.

We then created 10.8 bp/turn (33.3° twist per bp) 3D honeycomb-lattice and hexagonal-lattice DNA nanostructures. Four types of 4-domain DNA strands were designed for 3D honeycomb-lattice DNA nanostructures (FIGS. 4D, 4E). A 6H×6H×84B-HC nanostructure was successfully constructed and characterized (FIG. 4D, and data not shown). Particle in TEM images were measured to be 13 nm (±0.9 nm SD)×22 nm (±1.0 nm SD)×29 nm (±1.2 nm SD). Yield was estimated to be 30% (data not shown).

3D Hexagonal-Lattice DNA Nanostructures.

Figure 4G:
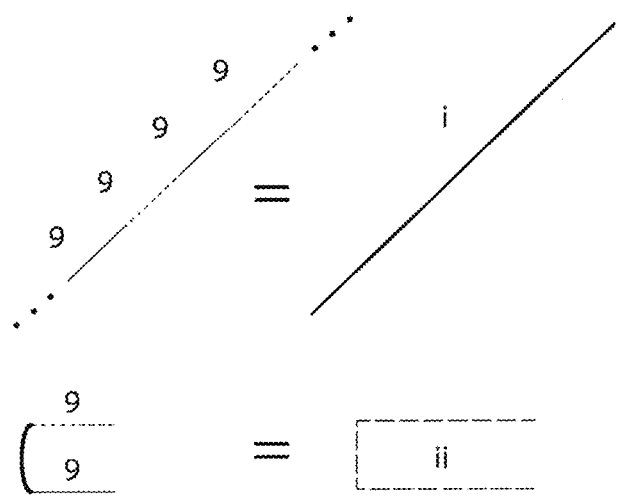
FIG. 4G is a schematic of two types of strands designed for formation of a hexagonal-lattice 3D DNA nanostructure.
Figure 4H:
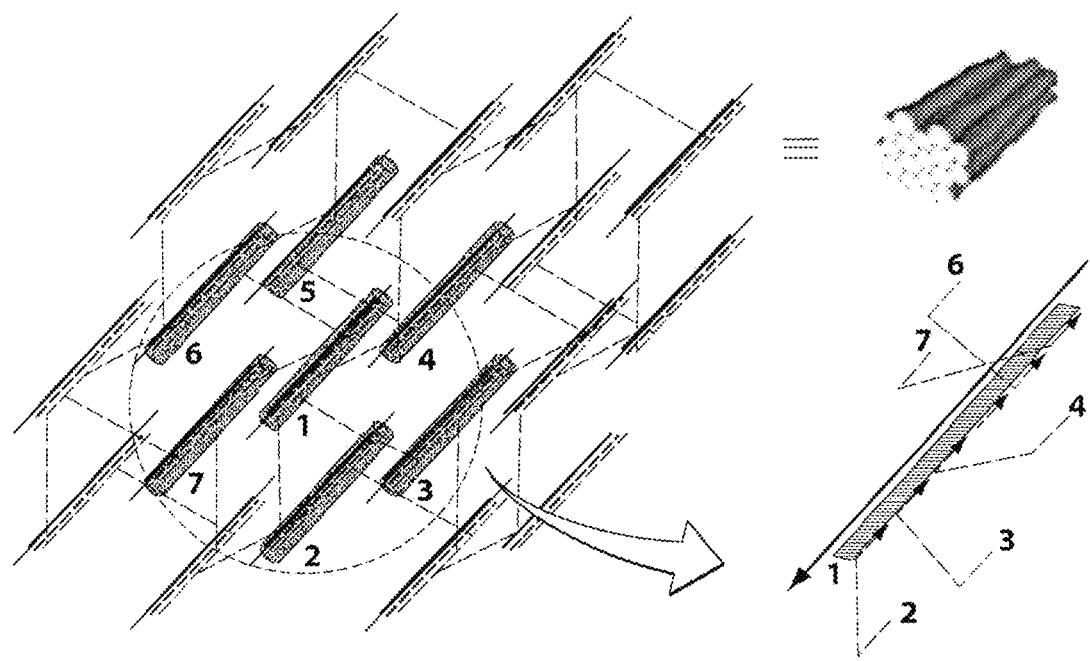
FIG. 4H is a schematic of a strand diagram of a 54 bp 3D nanostructure. The right-bottom image depicts an enlarged image of the circled helix bundle. Strand colors match those described in FIG. 4D.
Figure 4I:
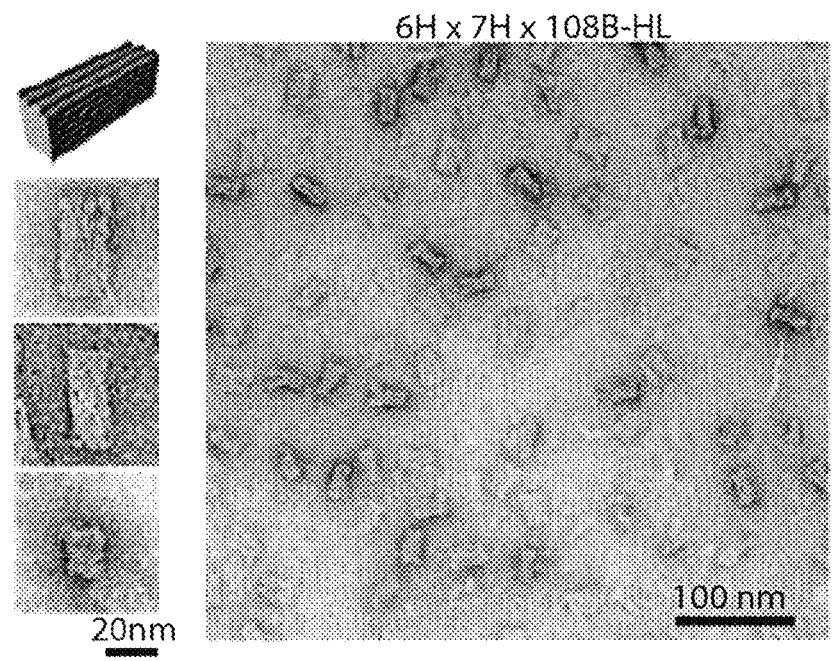
FIG. 4I shows TEM images of a 6H×7H×108B-HL (hexagonal lattice) 3D DNA nanostructure. Insets show enlarged images of the different projections of the structures/particles

Two types of strands are implemented to build a 3D hexagonal-lattice DNA nanostructure: a linear strand with multi 9 nt domains and an 18 nt strand with two 9 nt domains that are connected by a crossover (FIGS. 4G, 4H). A 6H×7H×108B-HL nanostructure was constructed and characterized (FIG. 4I, and data not shown). Particles in TEM images were measured to be 13 nm (±0.8 nm SD)×18 nm (±1.1 nm SD)×35 nm (±2.2 nm SD). Yield was estimated to be 26% (Fig. S64).

Other Motif Designs.

Figure 19A:
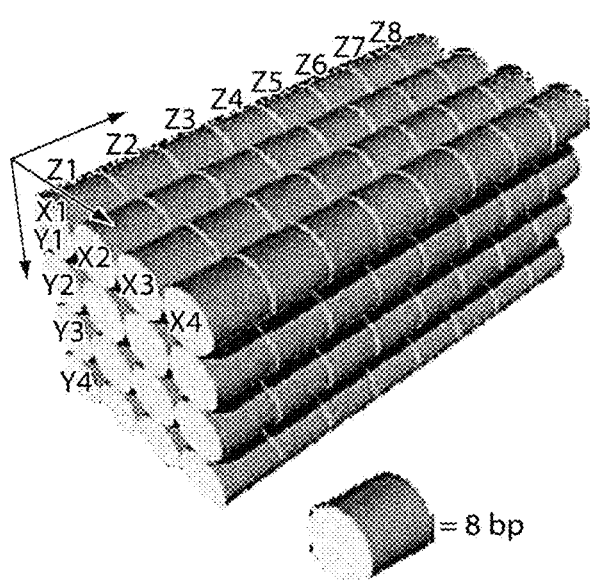
FIGS. 19A-19E show 3D structure design with alternating strands.
Figure 19B:
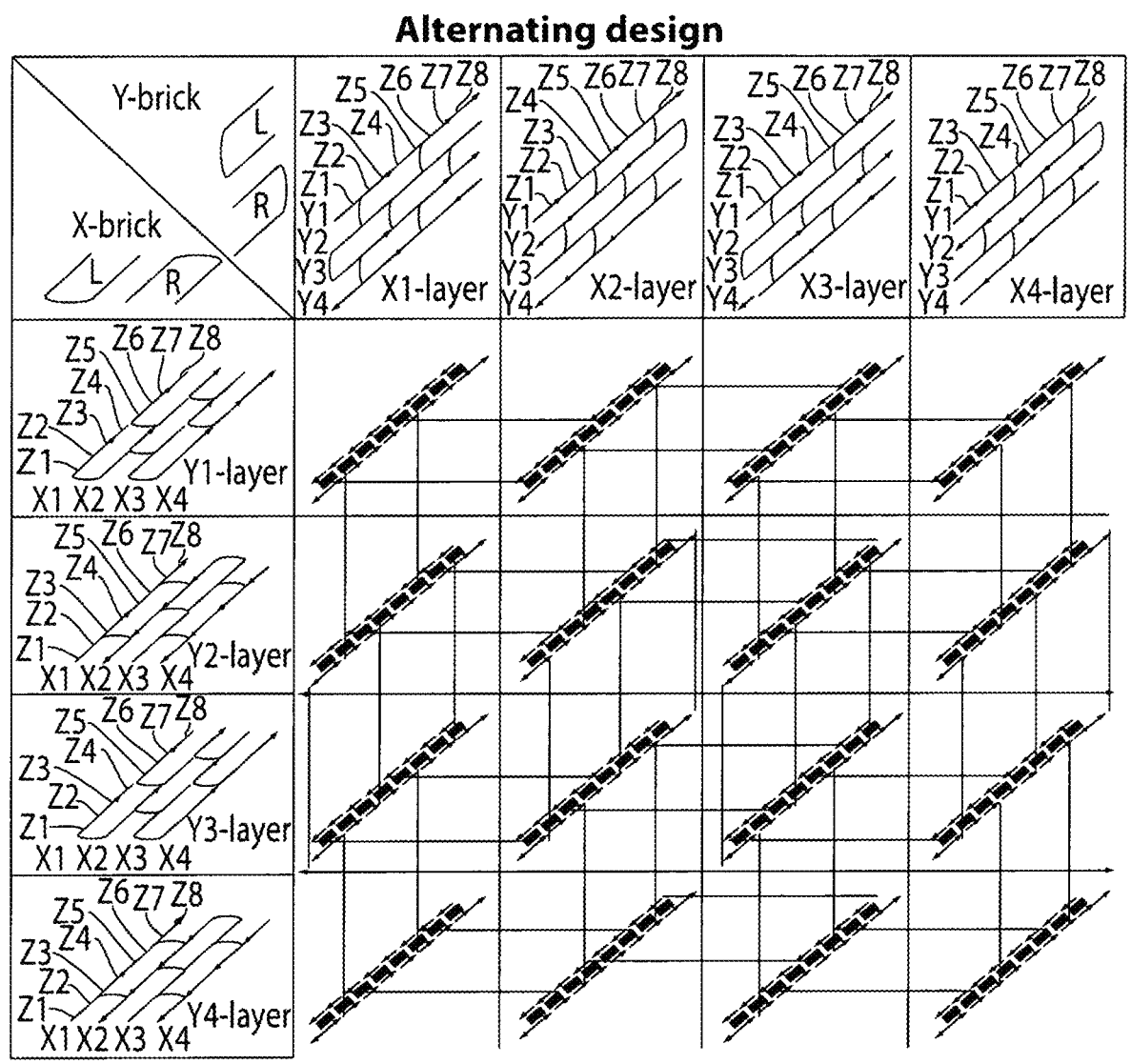
Figure 19C:
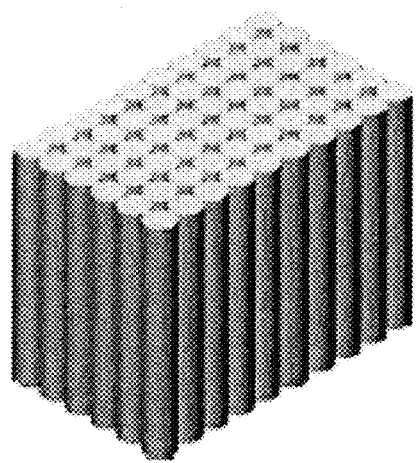
Figure 19D:
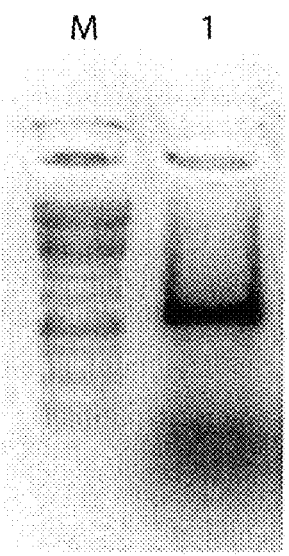
Figure 19E:
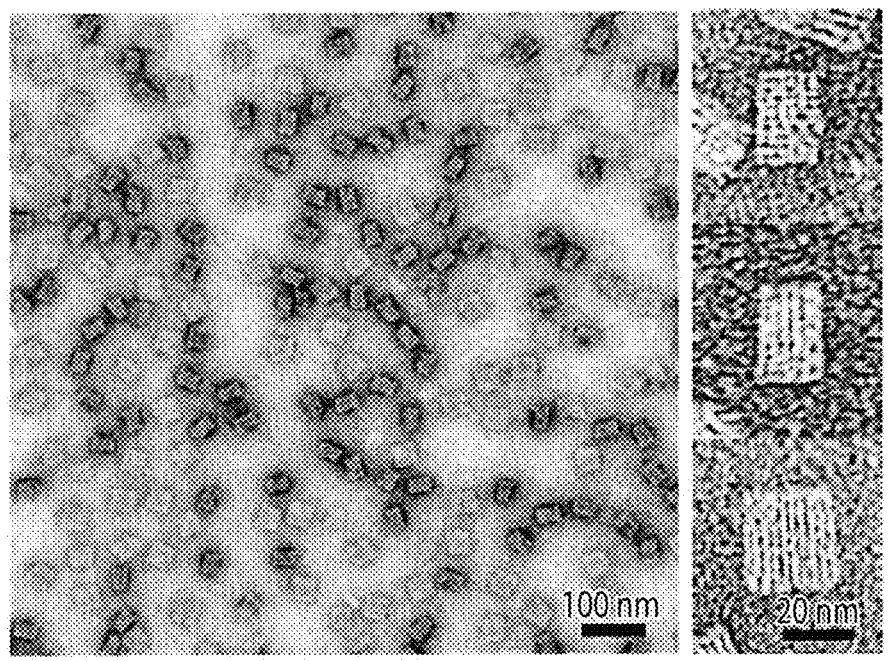

In contrast to the "unidirectional" design, strands can also be designed to point to opposite directions in a 3D nanostructure. Here we demonstrate a design strategy in which strands in odd number layers point in the Z− direction and strands in even number layers point in the Z+ direction (FIG. 19B). We designed and tested self-assembly of a 6H×6H×64B-A (alternating design), and two 6H×6H×64B nanostructures that implement two other DNA motif designs (data not shown). Successful self-assembly of 6H×6H×64B-A was confirmed by agarose gel electrophoresis and TEM imaging. Our results also demonstrated that strand design has much higher yield than the other two motif designs. Regardless of the sizes of nanostructures, crossovers are symmetrically arranged in such an alternating design. The success of these designs pictured a versatile methodology of modular DNA self assembly.

Example 4. DNA-Brick Crystals

Design of DNA brick crystals. All crystals were designed using 10.67 base-pair (bp)/turn twist density that is slightly departed from the 10.5 bp/turn twist density of natural B-form DNA. In an assembled structure, a DNA brick is a 32-nucleotide (nt) strand that can be depicted in a simple LEGO®-like brick model (FIG. 20A, top) containing four 8-nt binding domains. Many bricks—each with distinct sequences—assemble into a prescribed three-dimensional structure in a one-step annealing reaction (FIG. 20A, bottom).

Using "connecting" bricks between discrete three-dimensional DNA-brick structures yielded DNA-brick crystals. The design strategy was demonstrated on a small 6H (helix) by 6H (helix) by 24B (base pair) cuboid structure. The DNA bricks on the surfaces of a discrete DNA-brick design were modified to connect the individual structures and extend the growth of crystals along the X-axis, Y-axis and Z-axis individually to generate one-dimensional-growth crystals, or combinatorially to generate two-dimensional-growth crystals (FIG. 20D and FIGS. 24A-24C). In order to achieve multimerization along the Z-axis, the sequences of the first layer of domains were modified to be complementary to those in the last layer of domains. Multimerization along the X-axis or Y-axis was achieved by substituting the bricks on the boundary along X-axis or Y-axis with new 32-nt bricks. Each of these new 32-nt bricks contained two domains complementary to one side of the cuboid and another two domains complementary to the opposite side of the cuboid. Thus, these 32-nt bricks connect the cuboid monomers to achieve continuous growth.

Although the DNA-brick crystals were designed from repeating units, the connecting bricks were the same as the other bricks in size and function. Therefore, unlike the hierarchical growth of DNA-origami crystals, the growth of the DNA-brick crystals of the invention may be non-hierarchical (FIG. 20C, top). Bricks were incorporated individually into a crystal during its growth, without first forming the repeating fundamental unit. The informational hierarchy—sequence uniqueness of bricks in a repeating unit—was preserved in a final crystal structure. By contrast, DNA-origami crystallization is a hierarchical process in which origami structures have to form completely and then are incorporated into a crystal (FIG. 20C, bottom).

Using this design strategy, we constructed and tested three groups of crystals: (1) one-dimensional "DNA-bundle" crystals extending along the Z-axis (referred to as Z-crystals); (2) two-dimensional "DNA-multilayer" crystals extending along the Z-axis and the X-axis (referred to as ZX-crystals); and (3) two-dimensional "DNA-forest" crystals extending along the X-axis and Y-axis (referred to as XY-crystals) (FIGS. 20D and 20E). Using different designs of repeating units, DNA-brick crystals with prescribed dimension(s) and pattern(s) can be made (FIG. 20F). Accordingly, a crystal design is named as "[the growth direction(s)]-[the size of the repeating unit]-[basic feature of its shape]". Like the discrete DNA-brick structures, sequences of all DNA-brick crystals were randomly generated, as described herein.

A crystal was assembled by mixing all unpurified DNA bricks together at equimolar ratios (100 nM of each strand) in 1×TE/MgCl$_2$ (5 mM Tris, pH 7.9, 1 mM EDTA, 40 mM MgCl$_2$) buffer, without careful adjustment of stoichiometry. The mixture was then subjected to a single-step 72-hour or 168-hour thermal annealing, followed by TEM imaging without any purification. The effective diameter of each DNA helix was measured to be 2.5 nm in all 3D crystals.

One-Dimensional-Growth DNA-Bundle Crystals (Z Crystals).

Figure 21A:
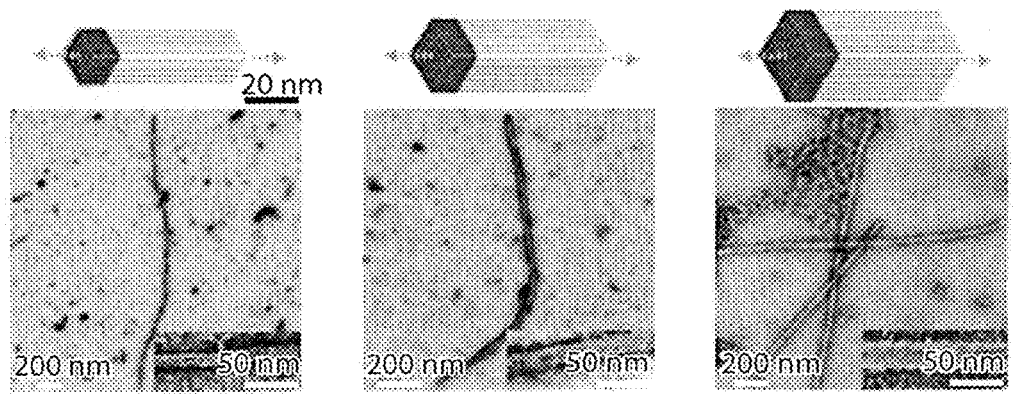
FIG. 21A shows models and TEM images of 6H×6H, an 8H×8H, and a 10H×10H DNA-bundle crystals, an 8H×8H DNA-bundle crystal with right-handed spiral channel, a 43H DNA-bundle crystal with triangle-shaped cross-section, and a 44H DNA-bundle crystal with hexagon-shaped cross-section.
Figure 21B:
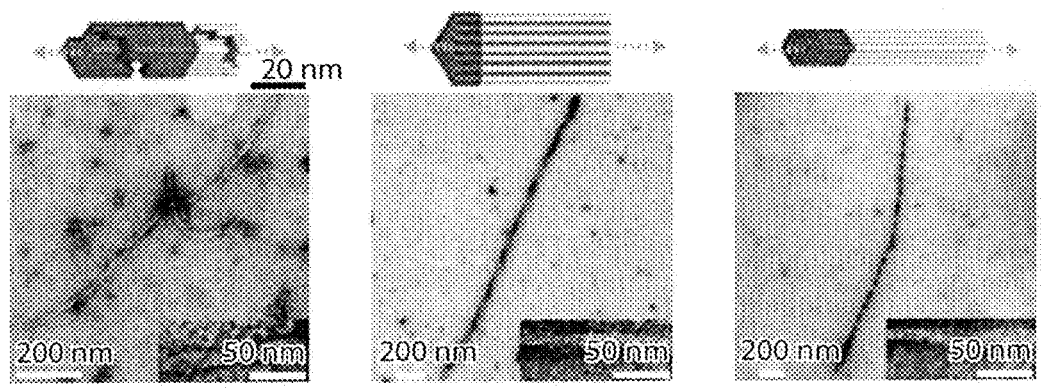
FIG. 21B shows models and TEM images of DNA-bundle crystals with tunnels: an 8H×8H DNA-bundle crystal with a 2H×4H tunnel, an 8H×8H DNA-bundle crystal with a 2H×2H tunnel and perpendicular 8H×2H×24B tunnels, a 12H×12H DNA-bundle crystal with a 6H×6H tunnel. The repeating units of each crystal are depicted as dark gray regions in the cylinder models.
Figure 21C:
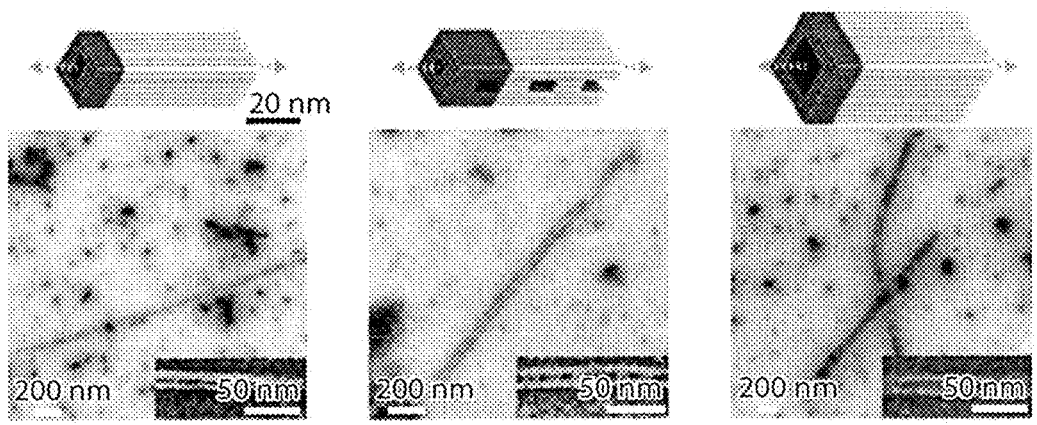
FIG. 21C shows additional models and TEM images of DNA-bundle crystals with tunnels.

We first made two groups of Z-crystals: (1) solid Z-crystals with different cross-sectional shapes, including a Z-6H×6H×32B, a Z-8H×8H×32B, and a Z-10H×10H×32B, a Z-8H×8H×128B-spiral, a Z-43H×32B-triangle, and a Z-44H×32B-hexagon (FIG. 21A); and (2) tube-shaped Z-crystals, a Z-56H×32B-tunnel, a Z-60H×64B-tunnel, and a Z-108H×32B-tunnel (FIG. 21B).

All Z-crystals exhibited global right handed twist in TEM images. The global twist is understood as a response to the stress generated by the 10.67 bp/turn underwinding design. The magnitude of twist was affected by the cross-sectional shapes of the Z-crystals. The Z-crystals formed easily. Most Z-crystals can grow to a few micrometers in length using a 24-hour annealing protocol. However, longer annealing protocols typically yield longer Z-crystals. Thus we used a 72-hour annealing protocol for all Z-crystals.

Three solid Z-crystals were designed using 32 bp repeating units. The square-shaped cross-sections of the Z-crystals contain a 6H×6H, 8H×8H, and 10H×10H cuboid, respectively. We then produced crystals with more complex cross-sectional shapes. A Z-8H×8H×128B-spiral crystal that displays a spiral channel along the Z-axis was successfully constructed. The channel is clearly visible in TEM images. We then constructed two simpler designs: a Z-43H×32B-triangle and a Z-44H×32B-hexagon. Both showed high assembly qualities comparable to the three square-shaped cross-section Z-crystals.

Three tube-shaped Z-crystals were then tested. The cross-section of the Z-56H×32B-tunnel is an 8H×8H square with a 2H×4H rectangle removed from the center. The cross-section of the Z-108H×32B-tunnel is a 12H×12H square with a 6H×6H square removed from the center. The Z-60H×64B-tunnel is the most complex design within this group. It contains a centered 2H×2H square tunnel along the Z-axis. In addition, 8H×2H×24B pores cross with the 2H×2H square tunnel in every 64 bp along the Z-axis. TEM images show many structures that appear to contain only half of the designed DNA helices. This may be due to the periodic 8H×2H×24B pores weakening the connections between the top half and the bottom half along the Y-axis.

Additional TEM images of the Z-crystals are shown in FIGS. 25A-25H.

Two-Dimensional-Growth DNA-Multilayer Crystals (ZX Crystals).

Figure 22A:
FIG. 22A shows cylinder models of a 4 layer, a 6 layer, a 10 layer and a 20 layer ZX-crystal.
Figure 22B:
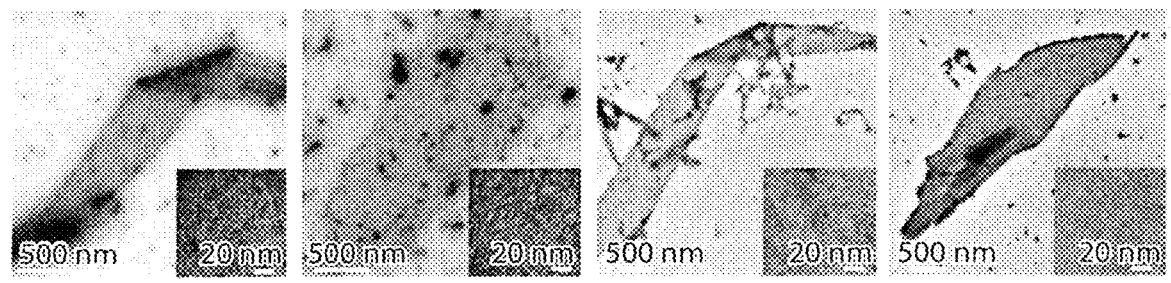
FIG. 22B shows TEM images of the ZX-crystals of FIG. 22A.
Figure 22C:
FIG. 22C shows TEM images of the folded crystals of FIGS. 21A and 21B. Arrows indicate the positions where the thicknesses of the crystals are measured.
Figure 22D:
FIG. 22D shows cylinder models of a 6 layer crystal with 2H×2H parallel channels: (left to right) a 6 layer crystal with two groups of crossing channels –2H×2H channels parallel to DNA helical axis and 2H×32B channels perpendicular to the DNA helical axis; a 6 layer crystal with 2H×6H×32B pores; a 10 layer crystal with two groups of no-contact tunnels –2H×2H tunnels parallel to DNA helical axis and 2H×24B tunnels perpendicular to the DNA helical axis. The two groups of tunnels are separated by two layers of DNA helices. The repeating units of each crystal are indicated as dark gray regions in the cylinder models.
Figure 22E:
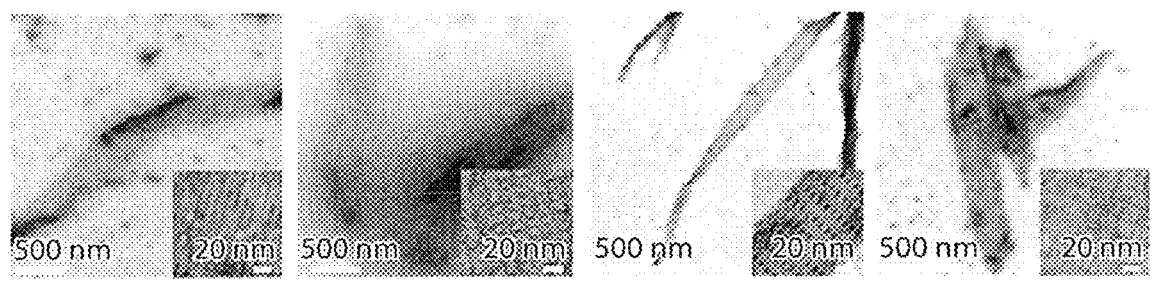
FIG. 22E shows TEM images of the crystals in FIG. 22D.

Two groups of ZX-crystals were then constructed: (1) solid ZX-crystals—ZX-4H×4H×32B-cuboid, a ZX-4H×6H×32B-cuboid, a ZX-4H×10H×32B-cuboid and a ZX-4H×20H×32B-cuboid that contains 4, 6, 10, and 20 layers of DNA helices, respectively (FIGS. 22A-22C); and (2) ZX-crystals with channels or pores—ZX-32H×64B-channels, ZX-32H×64B-cross-channels, ZX-6H×6H×64B-pores and ZX-96H×64B-cross-channels (FIGS. 22D and 22E).

We observed that all ZX-crystals grew faster along the Z-axis than the X-axis. In some cases (e.g., the X-6H×6H×64B-pore crystal), the growth along the Z-axis was much faster, resulting in the ribbon-like ZX-crystals that appear on the TEM images. This phenomenon suggests that crystal growth along the Z-axis (helical axis) is easier to realize than crystal growth along X-axis or Y-axis. This is possibly because of (1) Z-axis growth results in more pi-pi base stacking; and/or (2) X-axis or Y-axis growth needs to overcome the extra energy penalty for packing negative-charged DNA backbones close to each other. Most ZX-crystals were produced using 72-hour annealing protocol, except for the most complex ZX-crystal design, the ZX-96H×64B-cross-tunnels, which was annealed for 168 hours before imaging. All ZX-crystals showed small amounts of right-handed twist, which arises from the 10.67 bp/turn under-wound design. As a result, we observed that the crystals sometimes bend and land on top of themselves in TEM images. However, the magnitude of twist for ZX-crystals appeared to be much less than for the Z-crystals because the bending positions were typically observed a few micrometers apart on a ZX-crystal.

Four solid ZX-crystals were designed from 4H×4H×32B units that contained 4 layers, 6 layers, 10 layers, or 20 layers of helices. The thickness of a ZX-crystal was directly measured at the positions where the crystal folds in TEM images (FIG. 22C). The thicknesses of the 4 layer, 6 layer, 10 layer, and 20 layer ZX-crystals were measured as about 10 nm, 15 nm, 25 nm and 50 nm, respectively, showing that the crystals were completely formed, and each DNA helix was about 2.5 nm in diameter. We first designed three ZX-crystals from a 6H×6H×32B cuboid unit. Four helices were removed from the cuboid to generate the ZX-32H×64B channel design. The second ZX-32H×64B-cross-channel design was generated by removing a 2H×32B channel from the ZX-32H×64B-channel. The third ZX-6H×6H×64B pore design contained a 2H×4H×32B vertical pore along the Y-axis in each cuboid unit. This design yielded narrow and long crystals, likely due to less connection along the X-axis. The most complex ZX-crystal design was the ZX-96H×64B-cross-tunnel crystal. Its repeating unit can be considered as a 10H×10H×64B (6400 bp) cuboid with a 2H×2H×64B pore along the Z-axis and a 10H×2H×24B pore along the X-axis. Two groups of no-contact tunnels running perpendicular to each other were achieved. The two groups of tunnels were separated by two solid layers of DNA helices. Such rationally-designed 3D porous features were harder to achieve using conventional origami methods.

Additional TEM images of ZX-crystals are included in FIGS. 26A-26H.

Two-Dimensional-Growth DNA Forest Crystals (XY-Crystals).

Figures 23A, 23B, 23C, 23D:
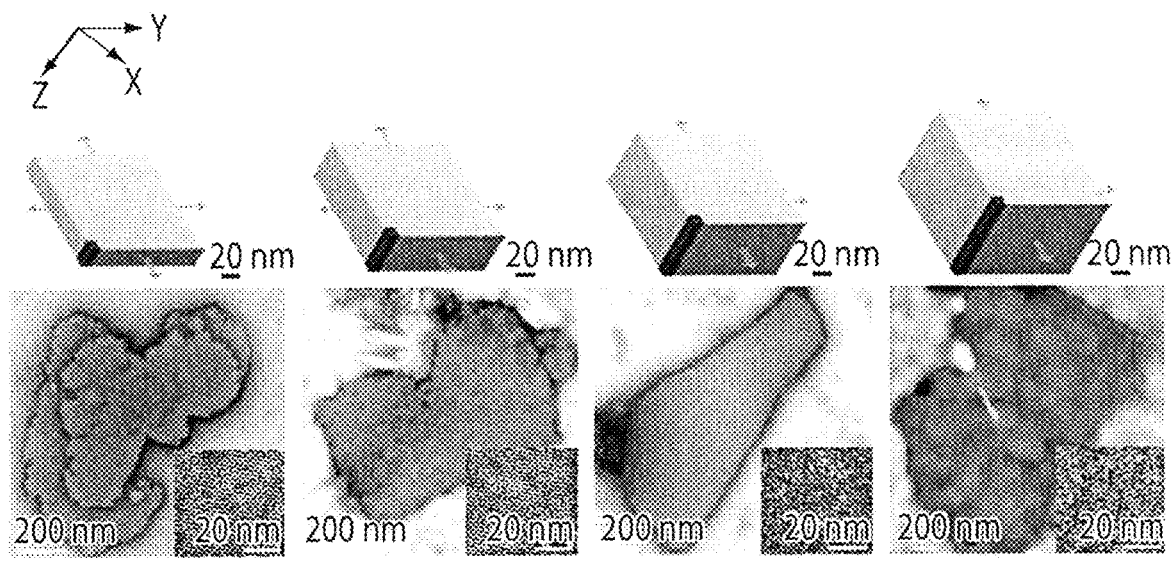
FIGS. 23A-23D show models of solid XY-crystals: 64 bp (A), 128 bp (B), 192 bp (C), and 256 bp (D). Cylinder models (top) and TEM images (bottom) are shown for each crystal.
Figures 23E, 23F:
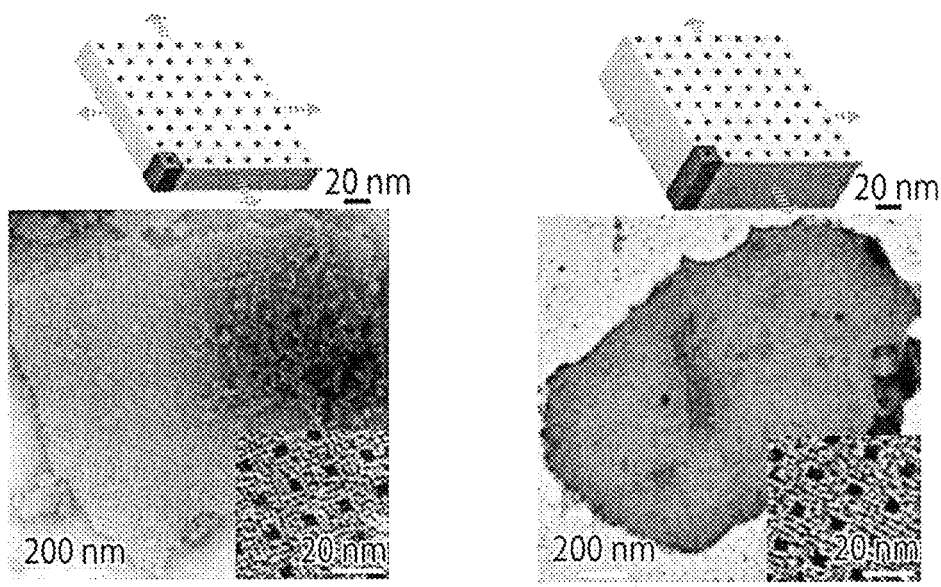
FIG. 23E shows a model of an XY-crystal with 2H×2H×64B parallel pores.
FIG. 23F shows a model of an XY-crystal with 2H×2H×128B parallel pores.
Figure 23G:
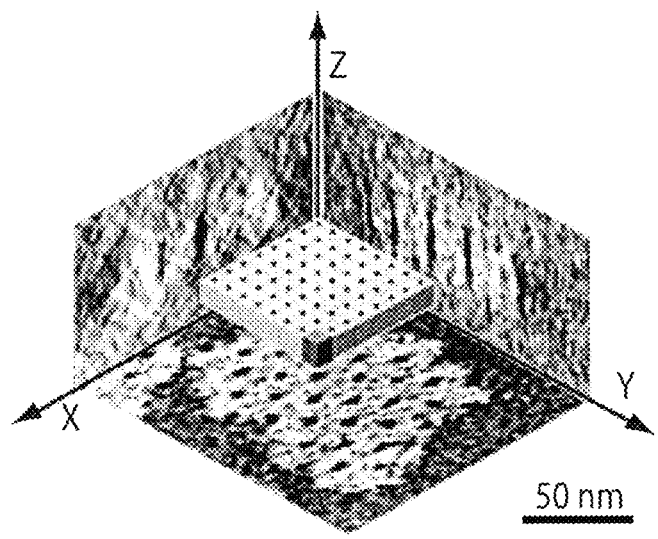
FIG. 23G shows a cryo-EM 3D reconstruction image of three projection views of a XY-32H×64B-pore crystal.
Figure 23H:
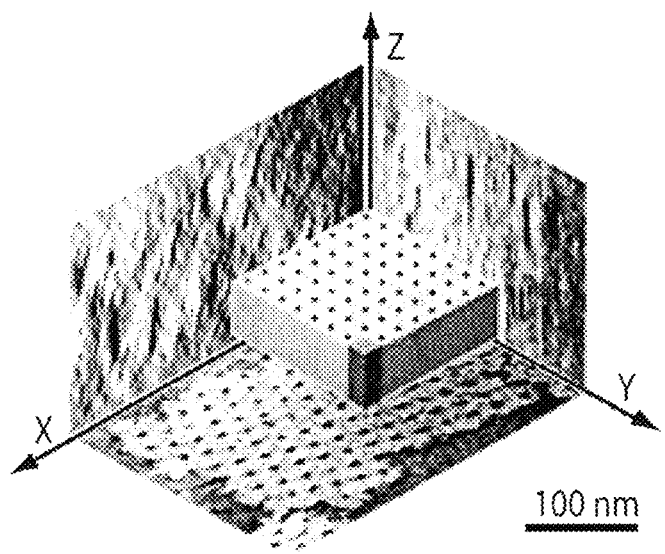
FIG. 23H shows a cryo-EM 3D reconstruction image of three projection views of a XY-32H×128B-pore crystal. Arrows indicate the positions where the thickness of the crystals is measured.
Figure 23I:
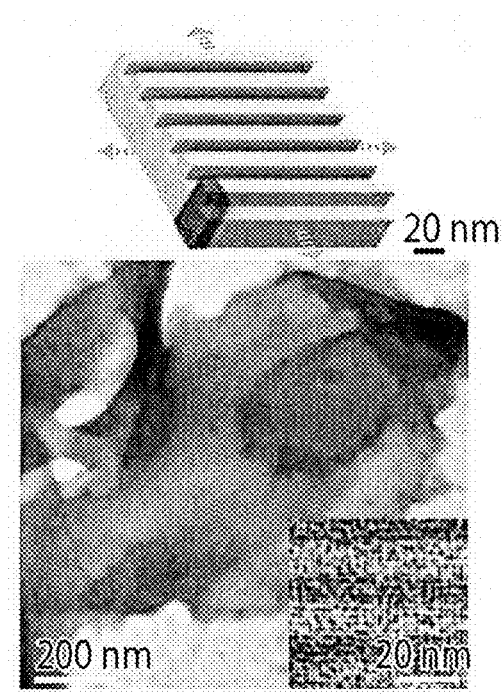
FIG. 23I shows a 96 bp crystal with 4H×32B parallel channels.
Figure 23J:
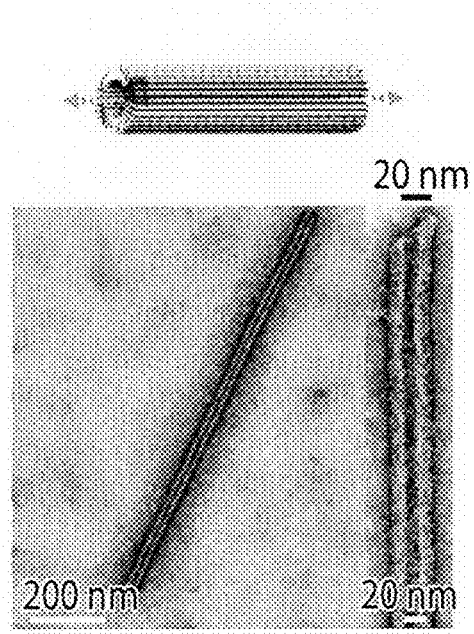
FIG. 23J shows a tube crystal formed by 32-bp helices that are perpendicular to the tube axis. Unit cells of crystals are denoted using dark-gray boxes.
Figure 24A:
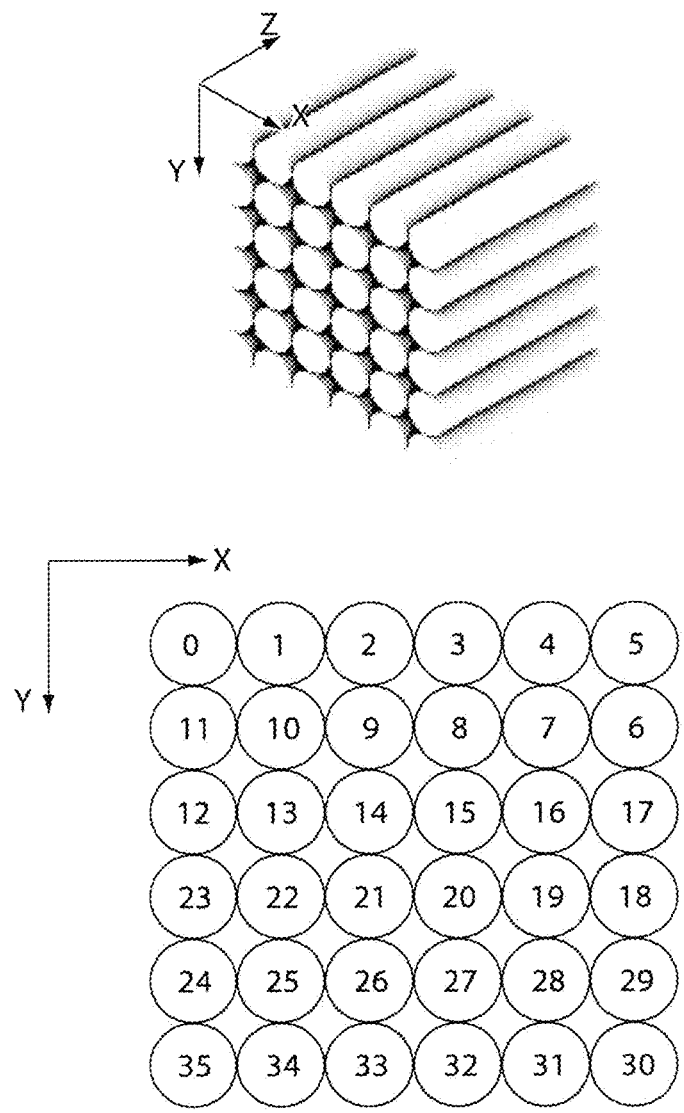
FIGS. 24A-24F show strand diagrams that show how the extended crystal is designed from a discrete object.
Figure 24B:
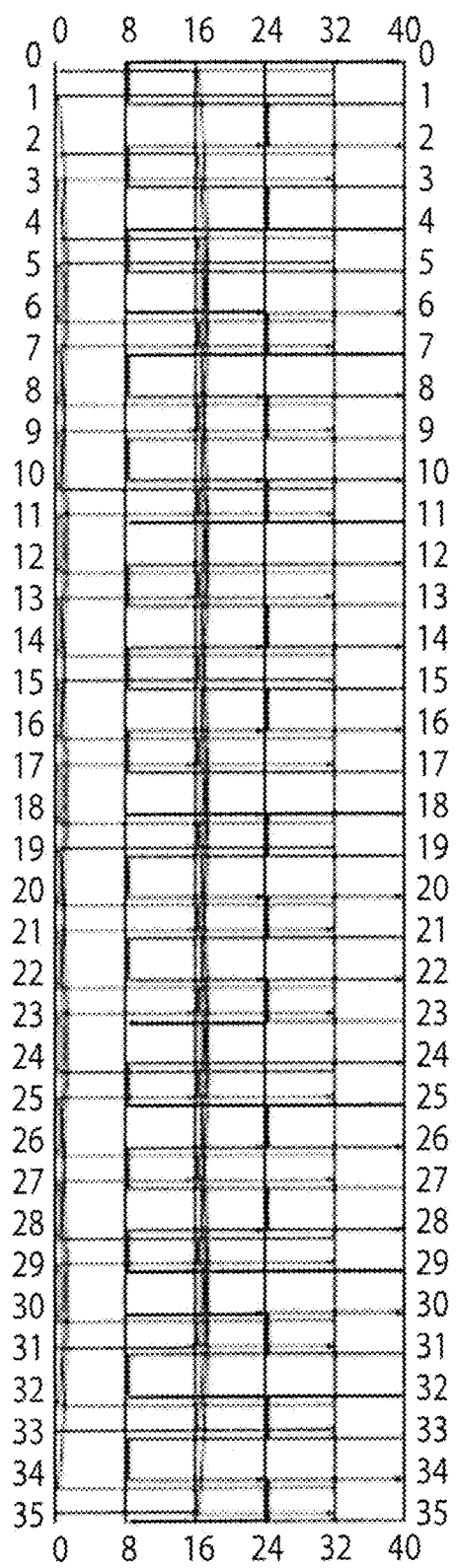
Figure 24C:
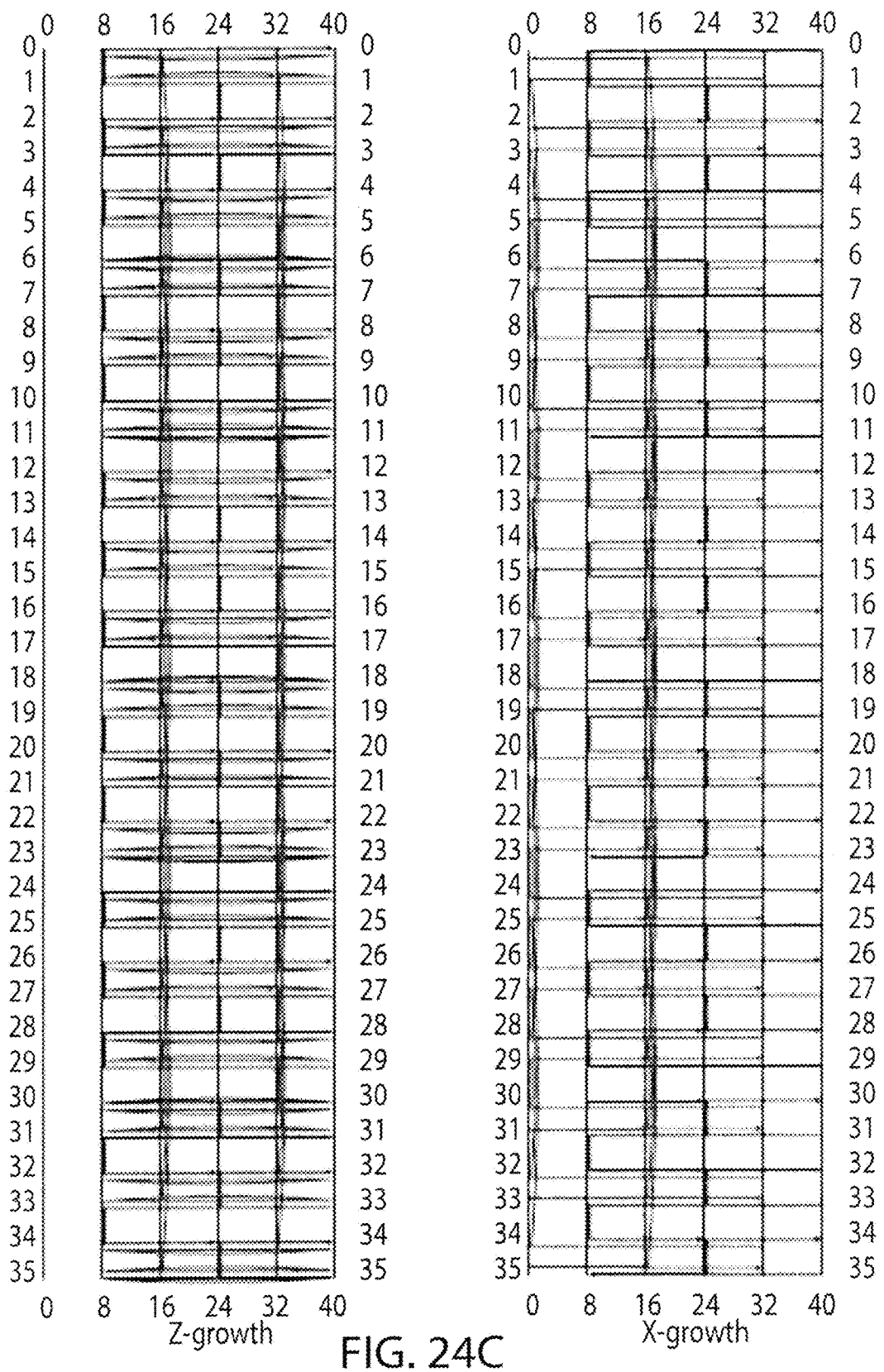
Figure 24D:
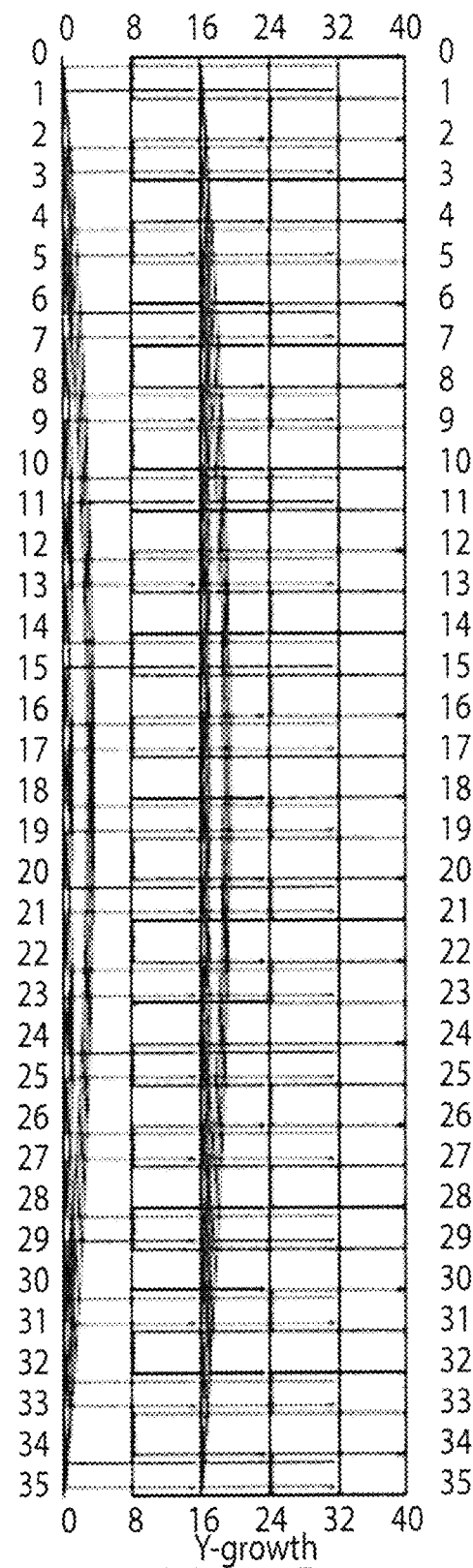
Figure 24E:
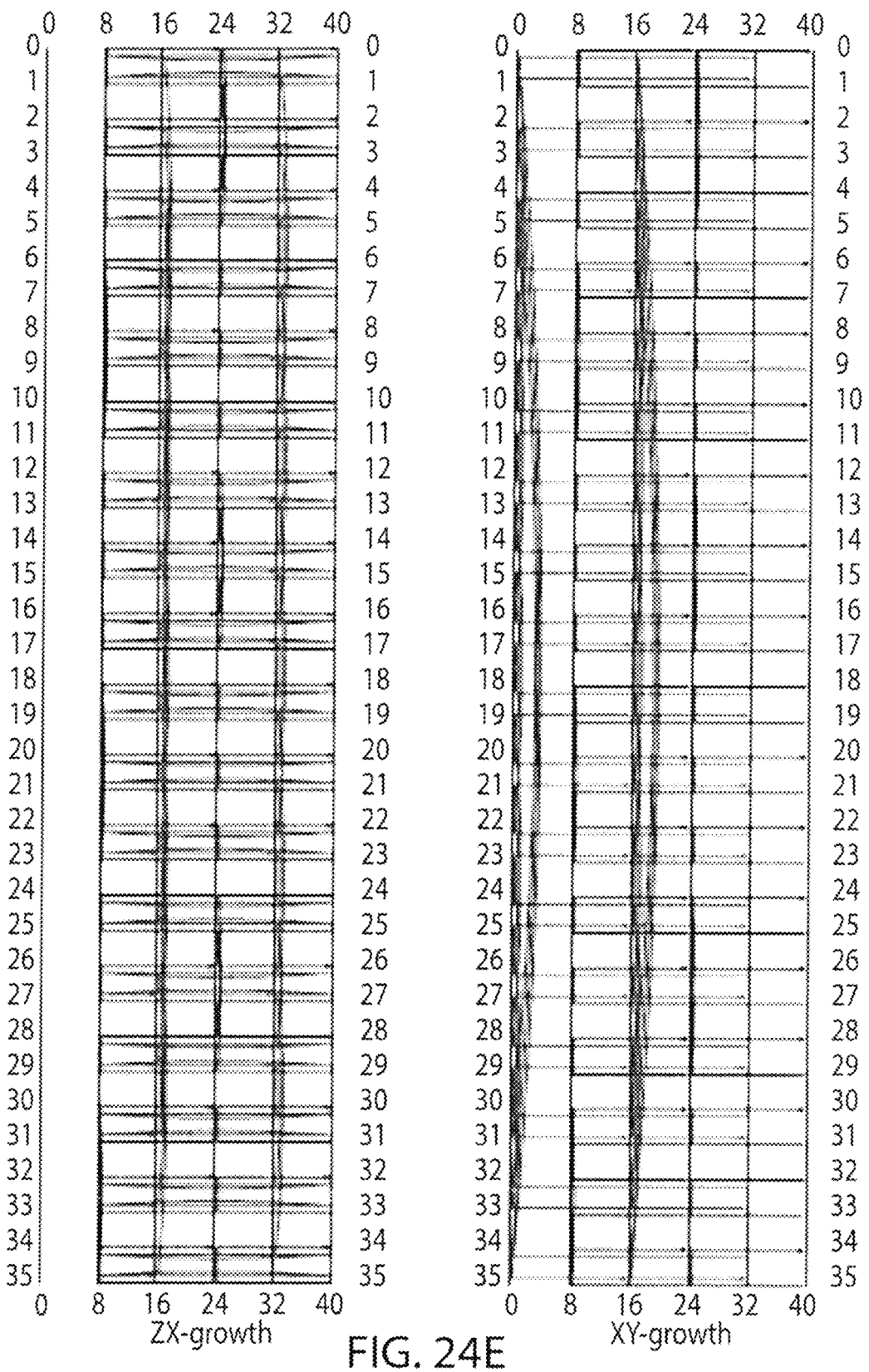
Figure 24F:
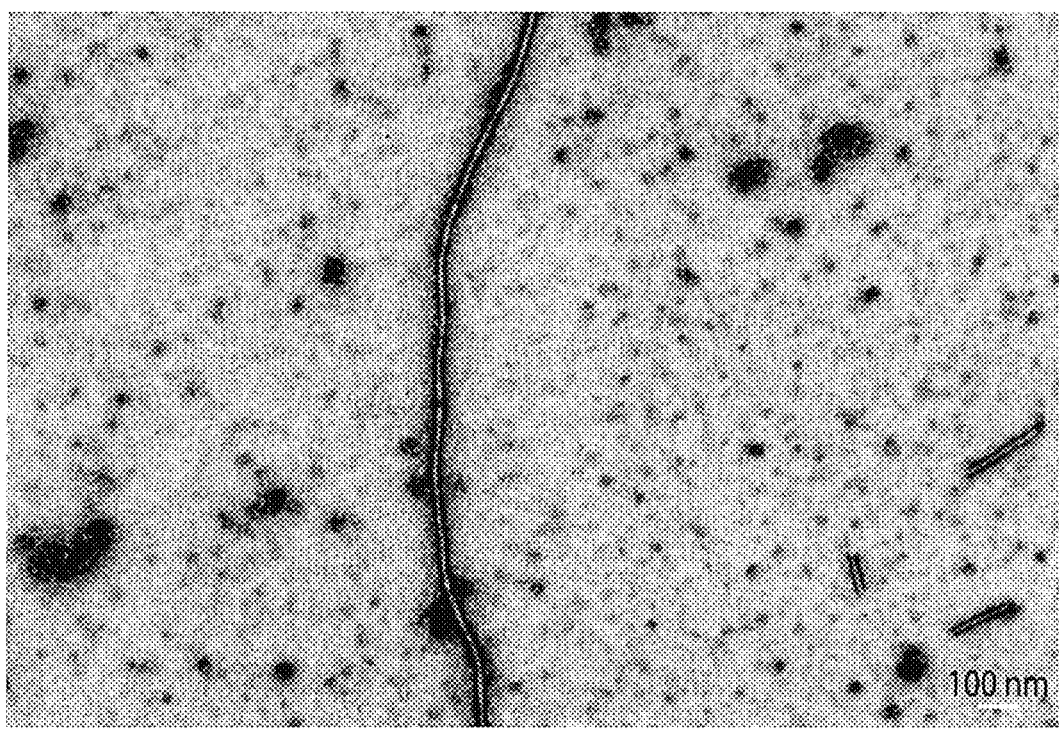
Figure 25A:
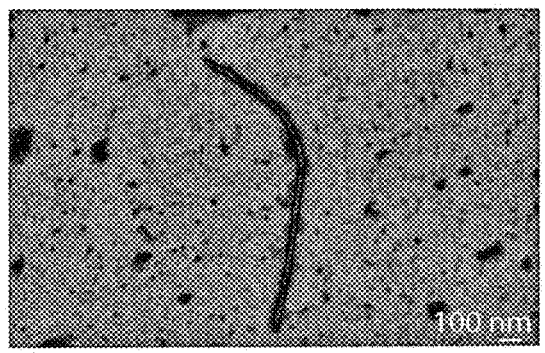
FIGS. 25A-25H show TEM images of Z-crystals. (A) Z-8H×8H×32B-cuboid crystal; (B) Z-10H×10H×32B-cuboid crystal; (C) Z-6H×6H×128B-spiral crystal; (D) Z-43H×32B-triangle crystal; (E) Z-44H×32B-hexagon crystal; (F) Z-56H×32B-tunnel crystal; (G) Z-60H×64B-tunnel crystal; and (H) Z-108H×32B-tunnel crystal.
Figure 25B:
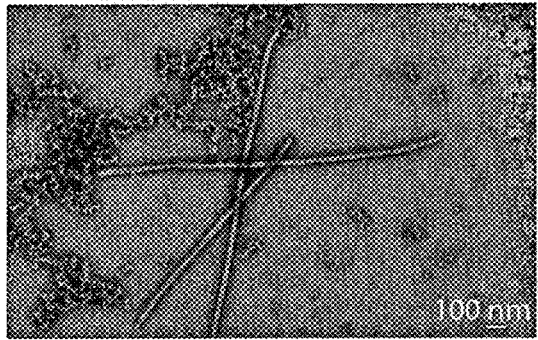
Figure 25C:
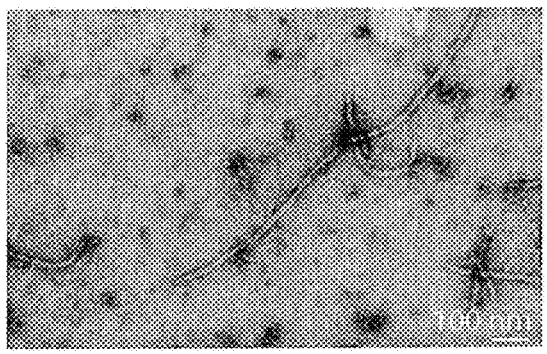
Figure 25D:
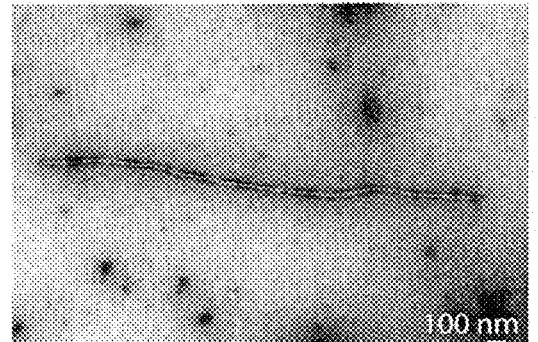
Figure 25E:
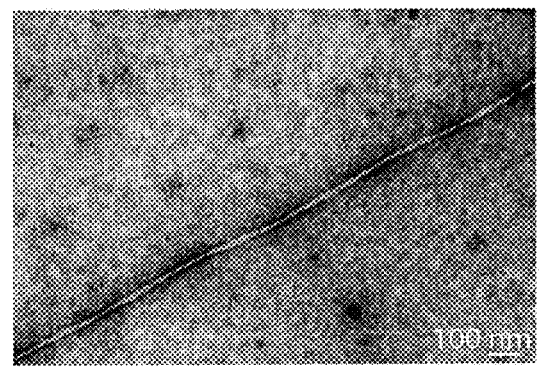
Figure 25F:
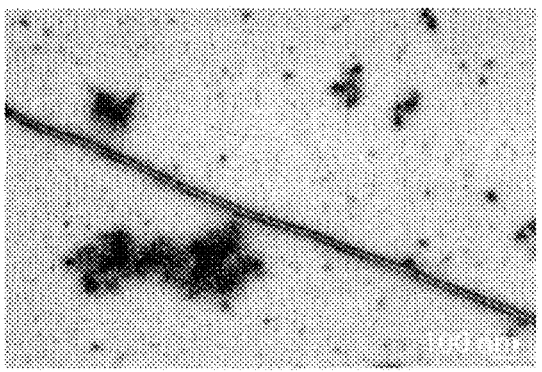
Figure 25G:
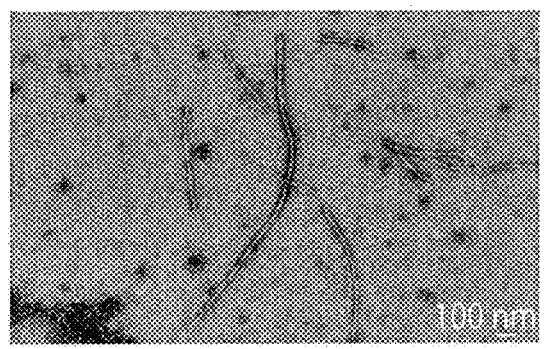
Figure 25H:
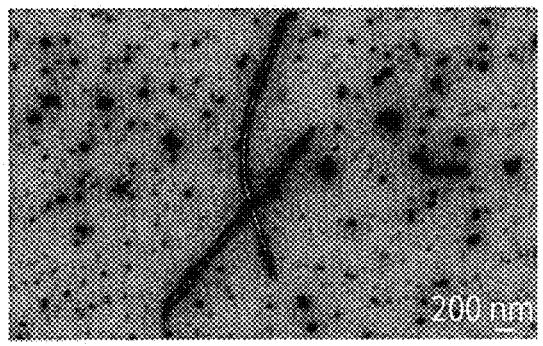
Figure 26A:
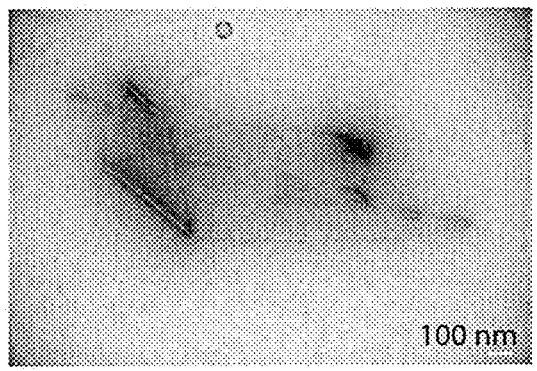
Figure 26B:
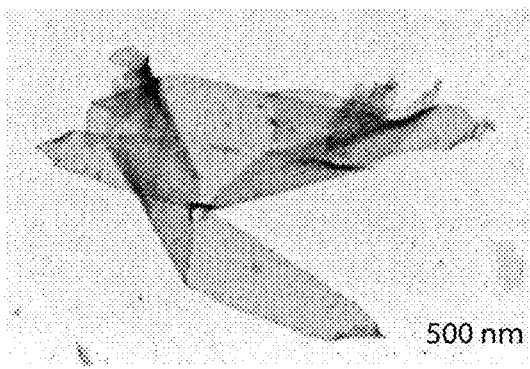
Figure 26C:
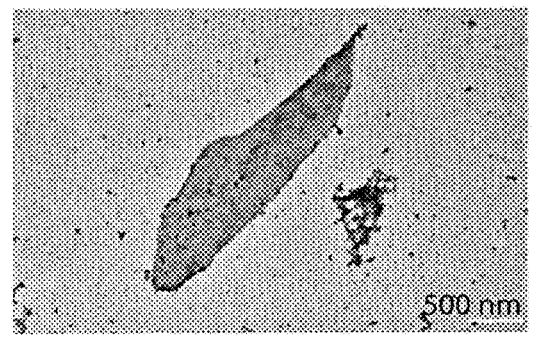
Figure 26D:
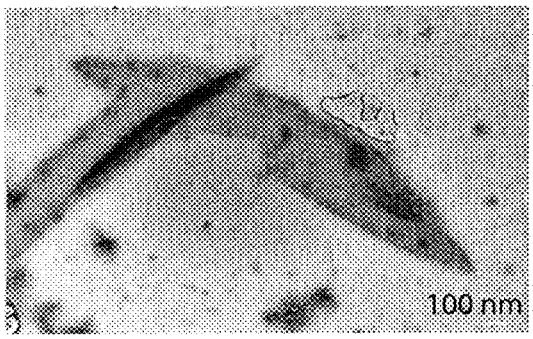
Figure 26E:
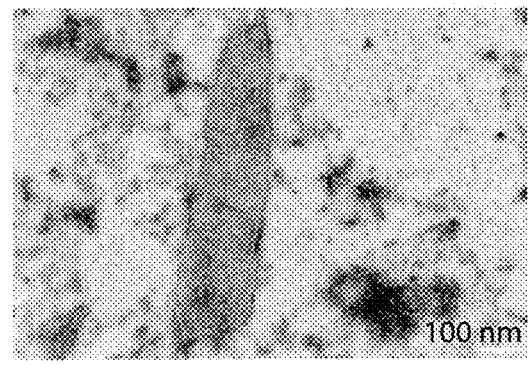
Figure 26F:
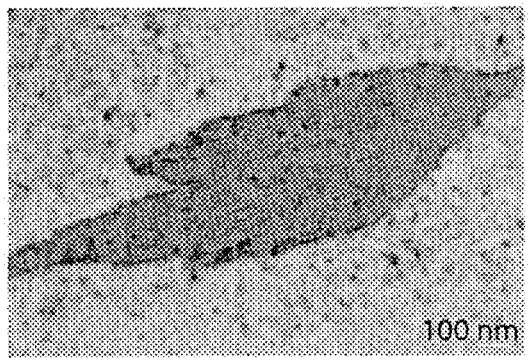
Figure 26G:
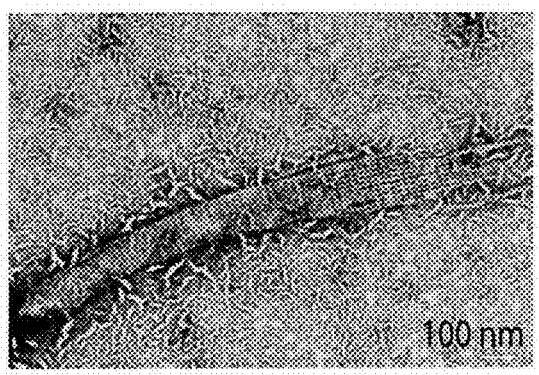
Figure 26H:
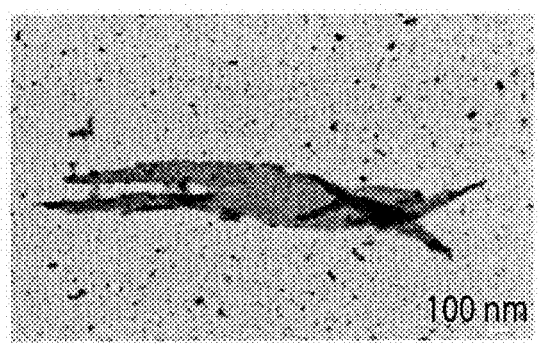
Figure 27A:
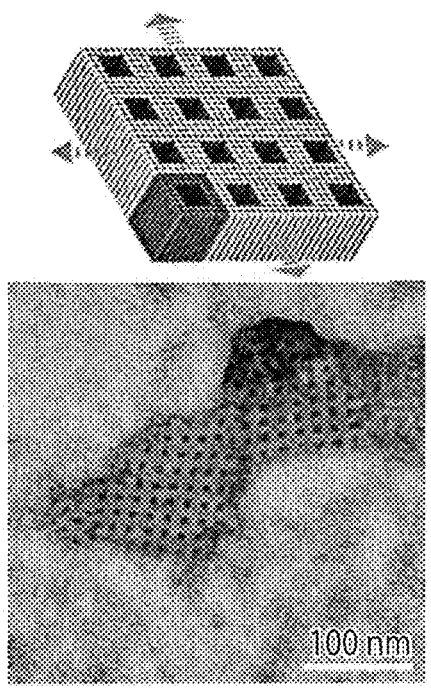
Figure 27B:
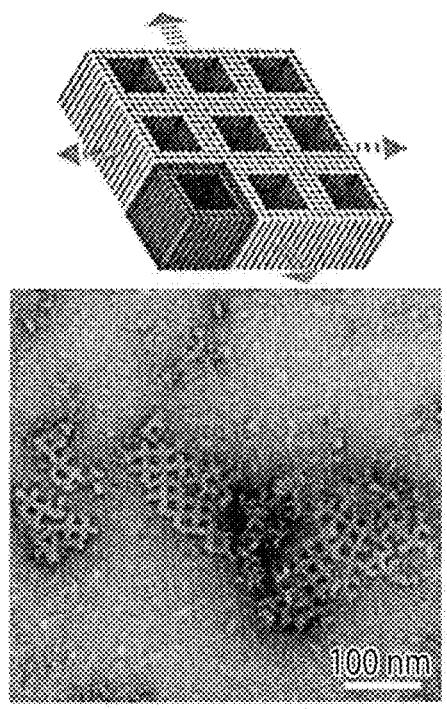
Figure 27C:
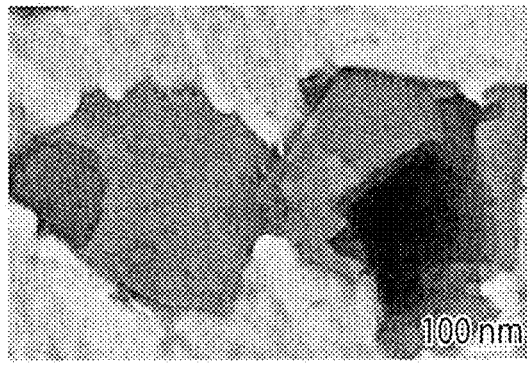
Figure 27D:
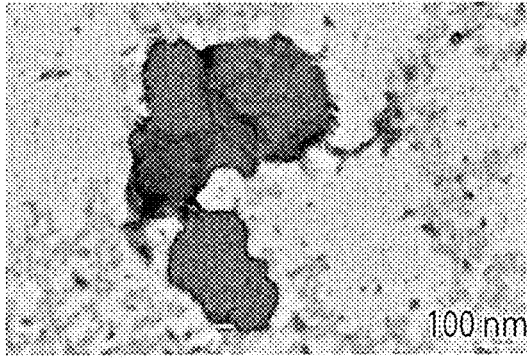
Figure 27E:
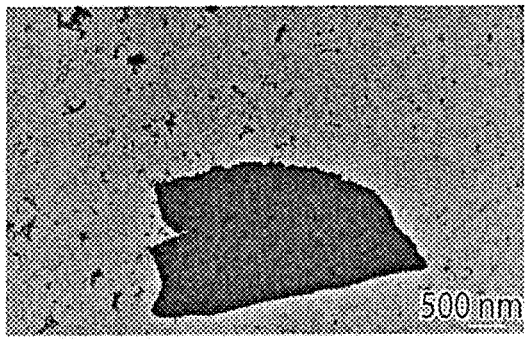
Figure 27F:
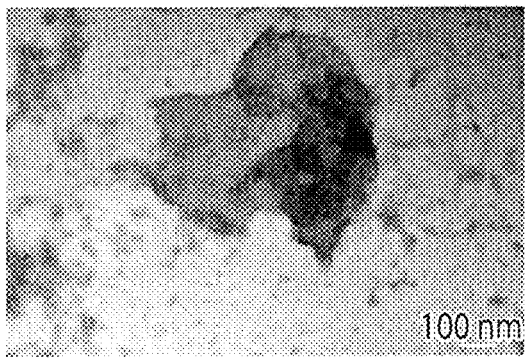
Figure 27G:
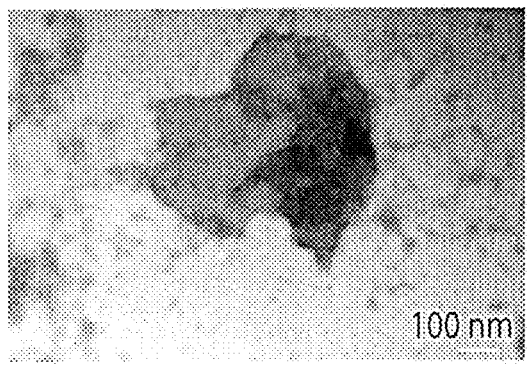
Figure 27H:
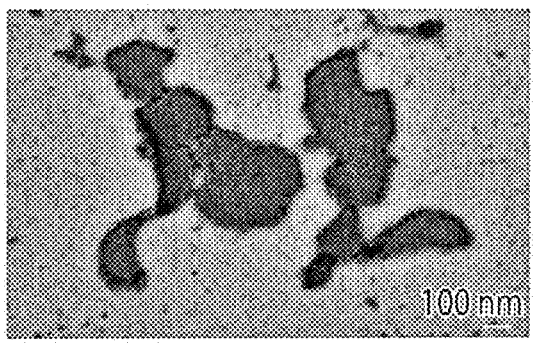
Figure 27I:
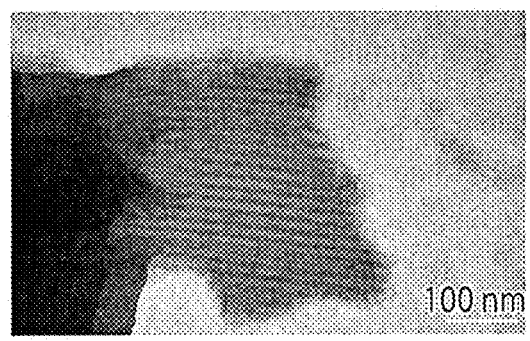

Lastly, we made two groups of XY-crystals: (1) solid XY-crystals—an XY-4H×4H×64B-cuboid, an XY-4H×4H×128B-cuboid, an XY-4H×4H×192B-cuboid, and an XY-4H×4H×256B-cuboid (FIGS. 23A and 23B); and (2) complex XY-crystals—an XY-32H×64B-pore, an XY-32H×128B-pore, an XY-4H×8H×96B-channel, and an XY-4H×4H×32B-tube (FIGS. 23C and 23D).

The XY-crystals are two-dimensional growth crystals that eliminate the growth along DNA helical axis. By contrast, all previous two-dimensional DNA crystals implement DNA-helical-axis growth. Because crystal growth along X-axis or Y-axis is harder than growth along Z-axis, a 72-hour annealing protocol often produces no XY-crystal or XY-crystals smaller than a few hundred nanometers along the X-axis or the Y-axis. Therefore, we used a 168-hour annealing protocol for all XY-crystals in FIG. 23. The growth of XY-crystals was isotropic and did not show apparent direction preference because the two growth directions (X-axis and Y-axis) were both perpendicular to the DNA helical axis.

The XY-crystals did not show any global right-handed twist in our images. In order to simplify the analysis, we assumed that an XY-crystal forms a perfect cylinder that contains n helices. The overall twist in radians of the cylinder $\theta = TL/JG$, where T is the applied torque resulting from the underwinding design, L is the length of a helix, G is the modulus rigidity of a helix, and J is the torsion constant. The first three parameters can be considered constants. The torsion constant J for a circle as a function of cross-sectional radius (XY-plane) can be approximated with the following formula: $J=\pi r^4/2$, where r is the circular cross-sectional radius. Thus, the θ is inversely proportional to $r^4$, or to $n^2$. When an XY-crystal grows and n approaches 1, the global twist is quickly mitigated and can no longer be observed.

The flatness of the surfaces of XY crystals is a desirable property for some applications because positions and orientations of guest molecules can be precisely controlled even in solution. By contrast, the conformation of a twisted structure (e.g., a ZX-crystal) or a flexible structure (e.g., a single-layer DNA-origami crystal) in solution is difficult to accurately predict. In addition, the XY-crystals provide easy platforms for arranging matter because the crystals expose a very large number of DNA helices on the surface. Functionalized materials can be conveniently connected to the ends of DNA helices, which are closely packed at 2.5 nm resolution in each dimension.

Solid XY-crystals of variable thicknesses were designed from a 4H×4H cuboid unit. Using different lengths of the 4H×4H cuboid unit, four XY-crystals that were 64 bp, 128 bp, 192 bp and 256 bp in thickness were generated. Thicknesses of these solid XY-crystals could not be directly measured from TEM imaging because they were perfectly flat. If each base pair corresponds to a standard 0.33 nm length in B-form DNA, the thickness of the four crystals should be about 21 nm, 42 nm, 63 nm and 84 nm, respectively.

An XY-32H×64B-pore and an XY-32H×128B-pore crystal were constructed. Both designs contained periodic 2H×2H (5 nm by 5 nm) pores that were separated by 4 helices (10 nm) in each dimension. The two crystal structures resembled a 21 nm and a 42 nm thick porous membrane structure. To demonstrate that non-porous structures with surface features can be constructed, we made an XY-4H×8H×96B-channel crystal. It contained a solid 64 bp (42 nm) tall base and parallel channels. The channels were 4 helices (10 nm) in width, 32 bp (21 nm) in height, and separated by 4 layers of helices.

Additional TEM images of XY-crystals are shown in FIG. 27A-27I.

Figure 28A:
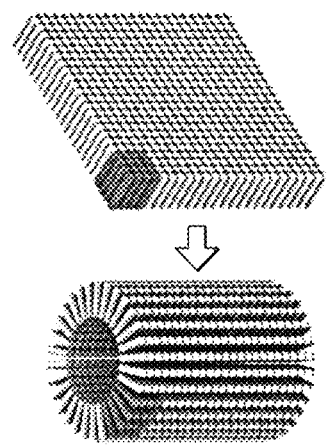
FIG. 28A shows a XY-4H×4H×32B-cuboid two-dimensional-growth crystal design (top) and how the structure can be used to form a tube (bottom).
Figure 28B:
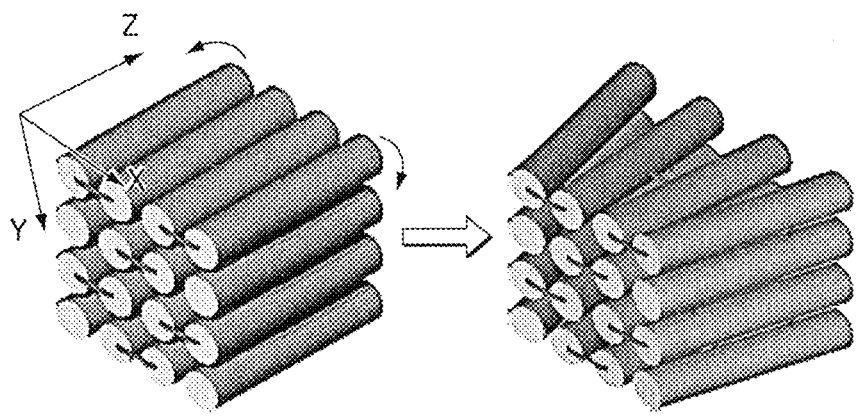
FIG. 28B shows a 4H×4H×32B-cuboid repeating unit expanded along the X-axis.
Figure 28C:
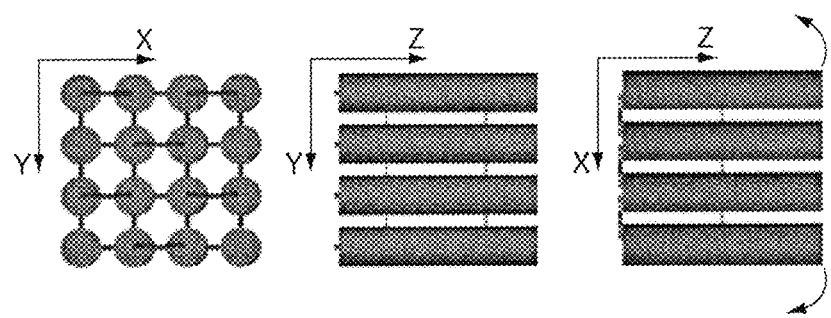
FIG. 28C shows projection views of a 4H×4H×32B-cuboid repeating unit. Along the Z-axis, the crossovers are asymmetrically distributed: half of the crossovers is located at the middle-point of the cuboid, and the other half is located at the left end of the cuboid.
Figure 29:
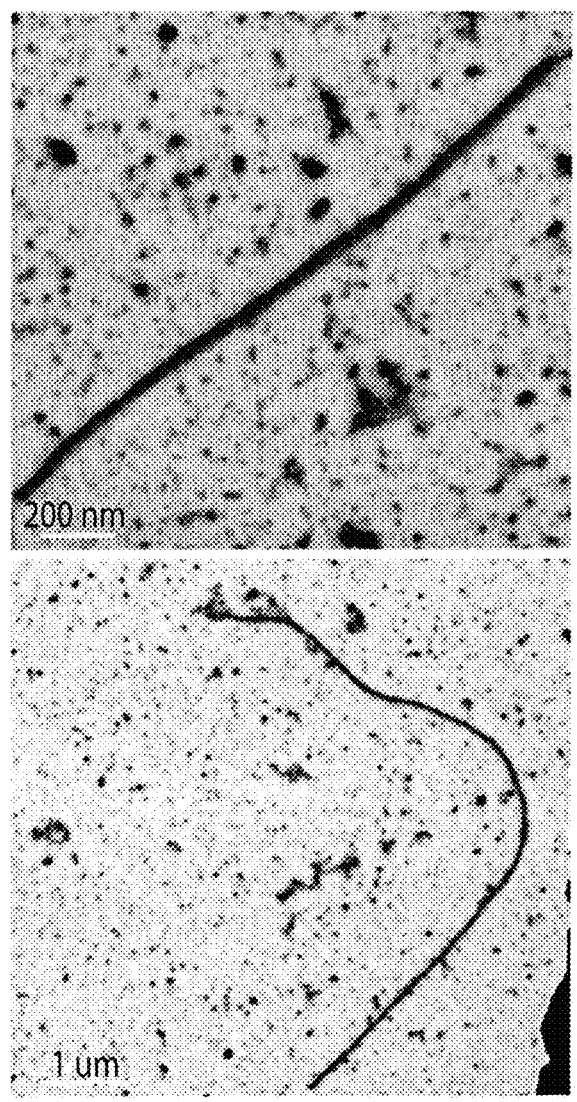
FIG. 29 shows TEM images of an XY-4H×4H×32B-tube crystal.
Figure 30:
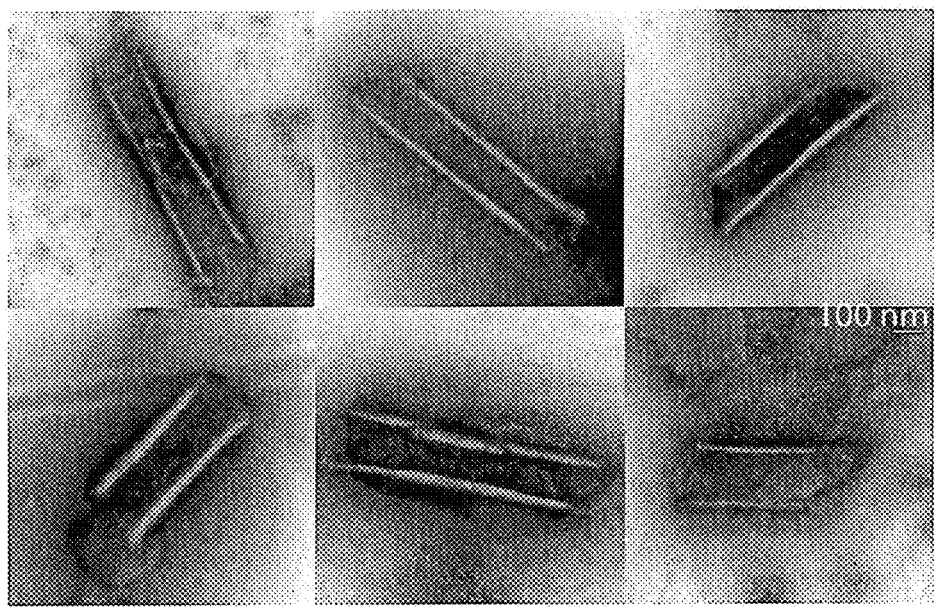
FIG. 30 shows TEM images of an XY-4H×4H×32B-tube crystal assembled in 60 mM of $MgCl_2$.
Figure 31:
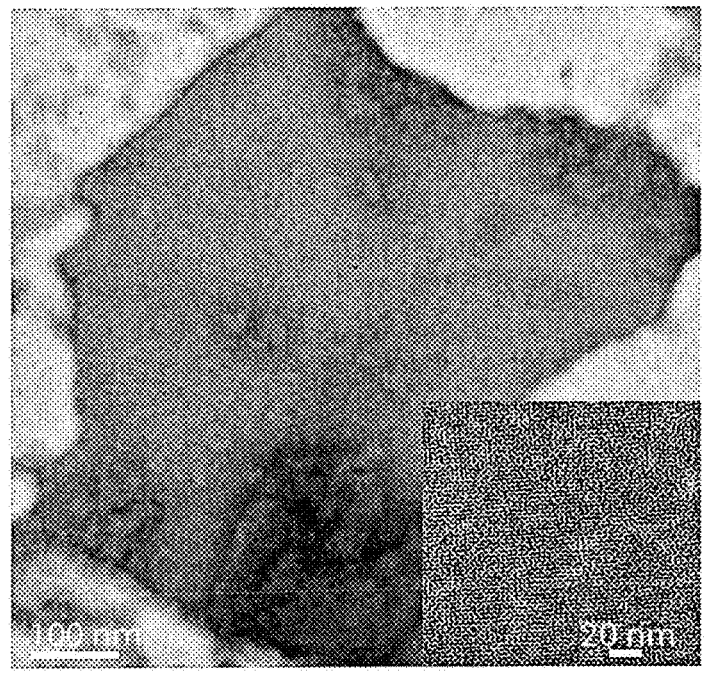
FIG. 31 shows TEM images of an XY-4H×4H×32B-cuboid crystal using alternating DNA-bricks.

A particularly interesting XY-crystal was the XY-4H×4H×32B-tube crystal. It was designed using same design strategy as other XY-crystals. This thin XY-crystal (32 bp, or 10.6 nm) formed a tube structure instead of a flat 2D crystal. Without being bound by theory, we hypothesize that the tube formation is due to the uneven distribution of connections between helices (FIGS. 28A-28C). Because helices in the XY-4H×4H×32B-tube are relatively short, there is only one connection between each pair of neighboring helices. The connections are evenly distributed along the Y-axis. Along the X-axis, half of the connections is located in the middle of the structure, and the other half is positioned at one side of the structure. Therefore, without being bound by theory, we hypothesize that the crystal expands at the opposite side and forms a tube. These tubes are narrow and can grow to several micrometers in length (FIG. 29). The diameters of tubes are about 14-20 nm with small variations. Annealing the XY-4H×4H×32B-tube in the presence of a higher $MgCl_2$ concentration can produce tubes with larger diameters because $Mg^{2+}$ can reduce the repulsion between negative-charged DNA helices. At 60 mM $MgCl_2$, we observed many tubes with diameters between 140 nm to 300 nm (FIG. 30). To further test our hypothesis, we designed an XY-4H×4H×32B-cuboid crystal in which the DNA bricks were arranged in an alternating fashion between layers. Connections between helices in this design were symmetrically distributed along both X-axis and Y-axis. TEM images demonstrated a flat crystal structure (FIG. 31). Thicker 64 bp, 128 bp, 192 bp and 256 bp XY-crystal designs had 2, 4, 6, and 8 connections between each pair of neighboring helices. No visible curvature was observed in TEM images for these designs.

Other DNA-Brick Crystals.

We further demonstrated that other types of DNA-brick crystals can be assembled from DNA bricks, including (1) two one-dimensional-growth crystals that extend along the X-axis and (2) a two-dimensional-growth crystal that implements an "offset" connection scheme.

Id X-Crystals.

Figure 32A:
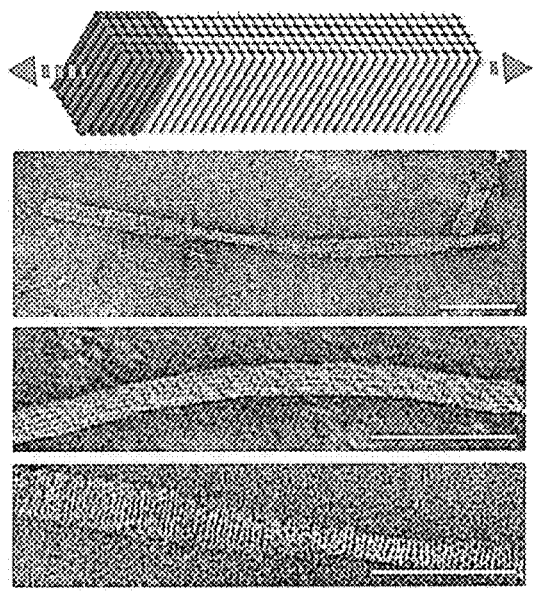
FIG. 32A shows an X-6H×6H×64B-cuboid crystal design and TEM images.
Figure 32B:
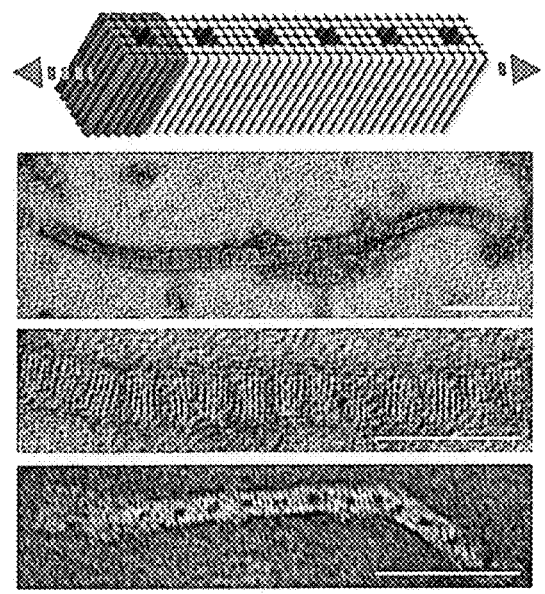
FIG. 32B shows an X-32H×64B-pore crystal design and TEM images. The dark regions represent repeating units.

Growing repeating units along the X-axis or Y-axis generated another type of one-dimensional-growth crystal. We designed and tested two X-crystals (note that X-crystals and Y-crystals should be very similar because of the symmetry of DNA-brick structures): a X-6H×6H×64B-cuboid crystal (FIG. 32A) and a X-32H×64B-pore crystal (FIG. 32B). The X-6H×6H×64B-cuboid crystal was designed based on a solid 6H×6H×64B cuboid unit. The X-32H×64B-pore crystal used a 6H×6H×64B cuboid unit with four helices removed from the center. Both crystals grew to a few hundred nanometers in length and appeared well-formed in TEM images. The average lengths of the two X-crystals were much shorter than the Z-crystals due to the close packing of large numbers of short DNA helices.

Offset 2D ZX-Crystals.

Figure 20B:
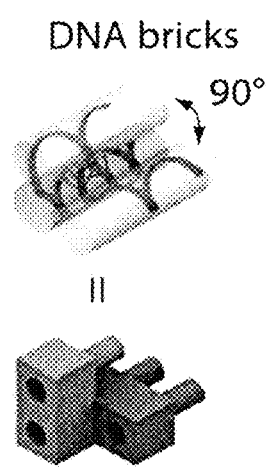
FIG. 20B shows a strand model (top) and a brick model (bottom) of a pair of 32-nucleotide single-stranded DNA bricks forming a 90° angle.
Figure 20C:
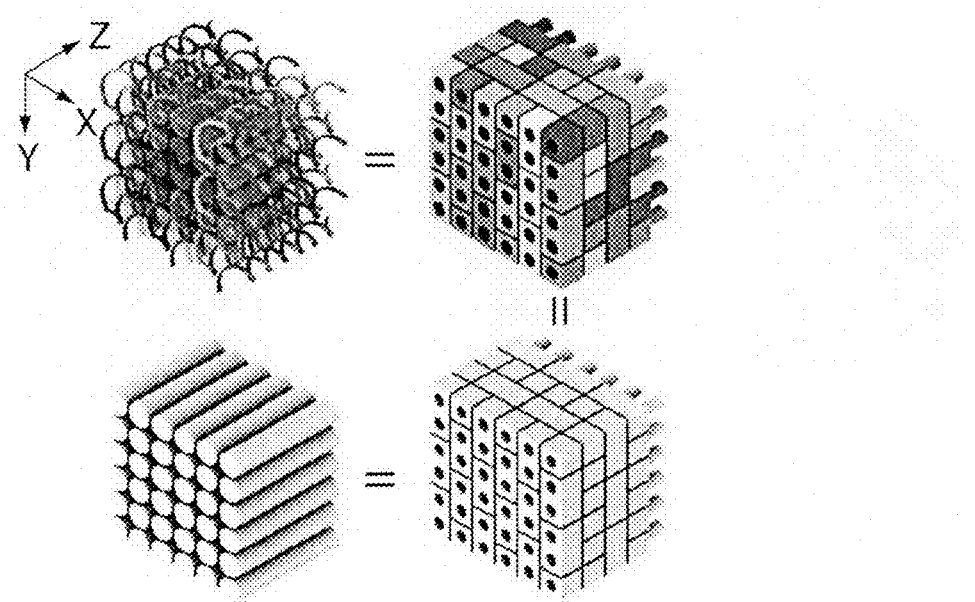
FIG. 20C, clockwise from the top-left, shows models of a 6H (helix)×6H×24B (base-pair) cuboid structure in order of most detailed to least detailed: a strand model in which bricks are labeled with different shades of gray, a brick model in which bricks are labeled with different shades of gray, a brick model in which all bricks are labeled with a light gray color, and a cylinder model that depicts DNA helices without showing bricks. Bricks have distinct sequences. The Z-axis is parallel to the DNA helices.
Figure 20D:
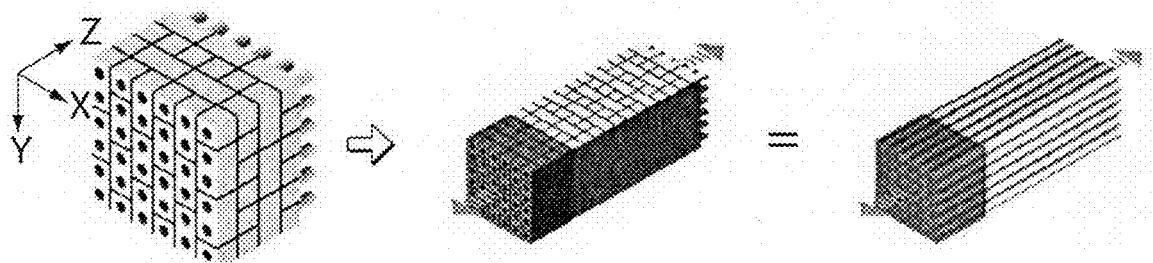
FIGS. 20D-20G show models of one-dimensional (1D), two-dimensional (2D) and three-dimensional (3D) DNA-brick crystals designed from the 6H×6H×24B cuboid.
Figure 20E:
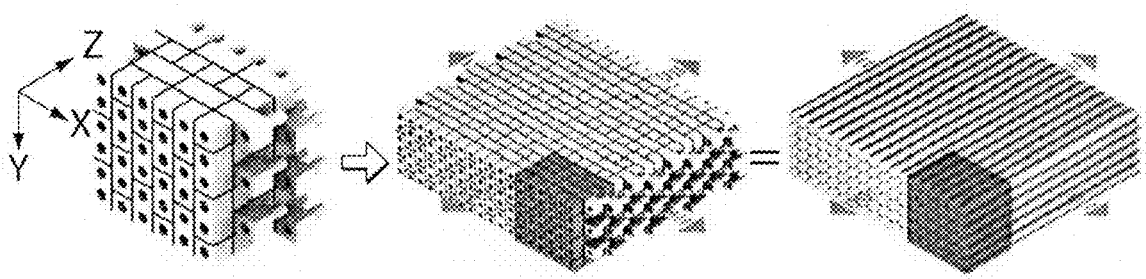
Figure 20F:
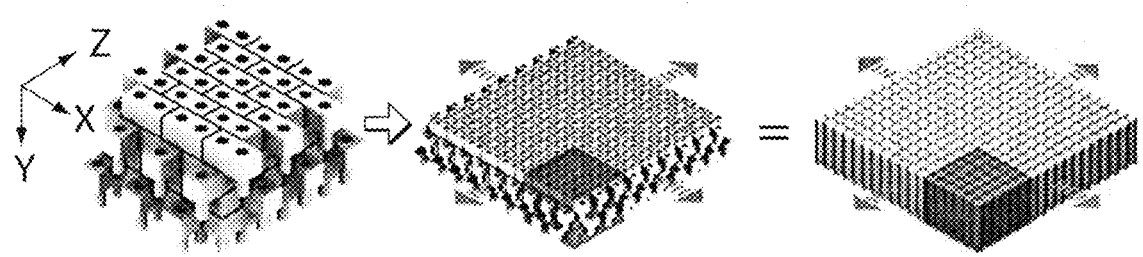
Figure 20G:
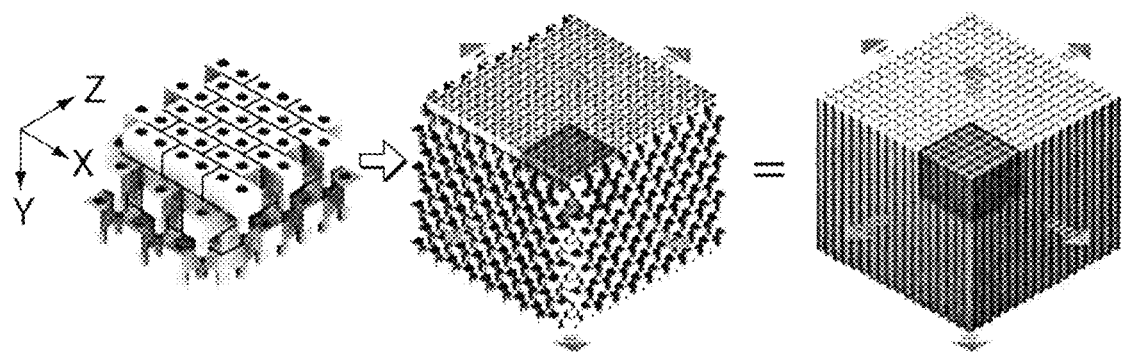
Figure 20H:
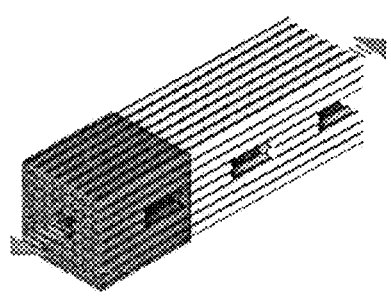
FIGS. 20H-20K show cylinder models of DNA crystals with channels, tunnels and cavities.
Figure 20I:
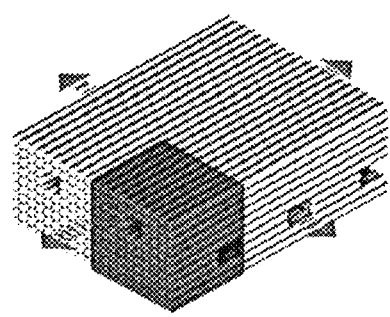
Figure 20J:
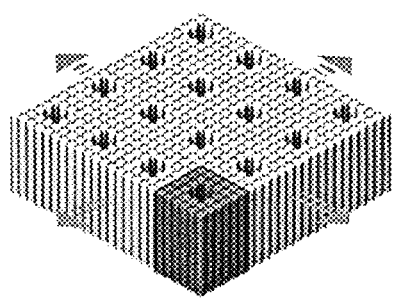
Figure 20K:
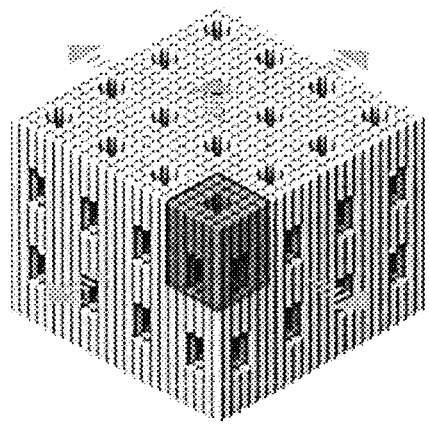
Figure 20L:
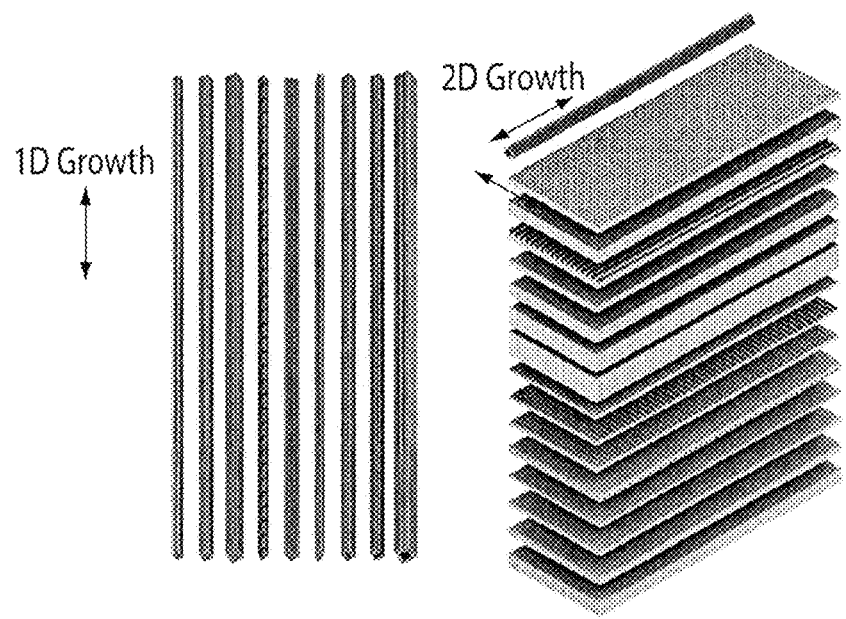
FIG. 20L shows complex DNA crystals in three-dimensional space.
Figure 20M:
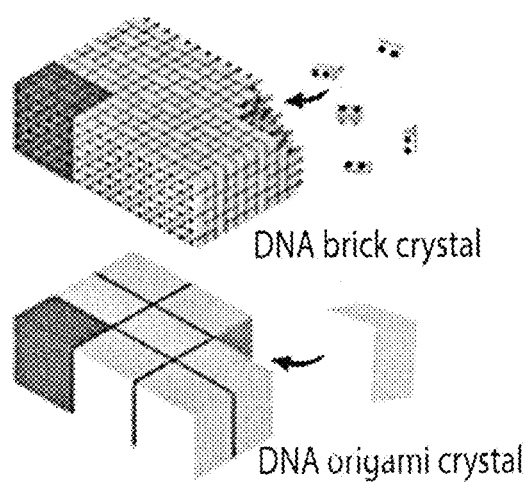
FIG. 20M shows a proposed assembly mechanism of a DNA-brick crystal of the invention compared to a proposed assembly mechanism of a DNA-origami crystal. Top: a 6H×6H×24B DNA-brick cuboid is extended to form a two-dimensional-growth crystal. Bricks are incorporated into the crystals individually. Bottom: a 6H×6H×24B DNA origami cuboid is extended to form a two-dimensional-growth crystal. Each cuboid needs to form correctly and then be incorporated into the crystal. The repeating informational units of both crystals are indicated in dark gray.
Figure 33A:
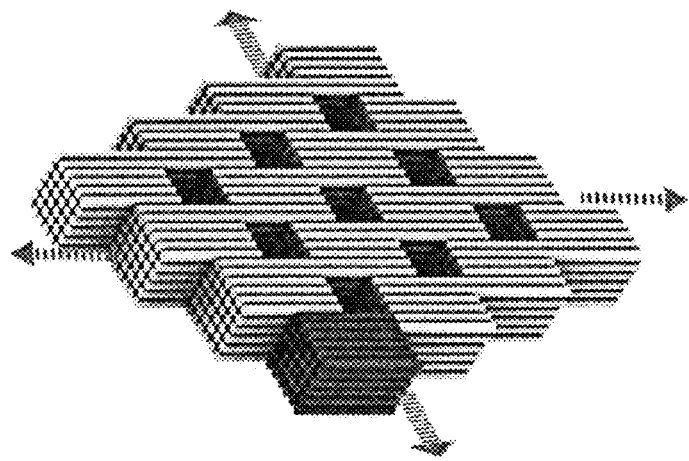
FIG. 33A shows the design of an offset-ZX-6H×6H×64B-cuboid crystal. The dark part represents a repeating unit.
Figure 33B:
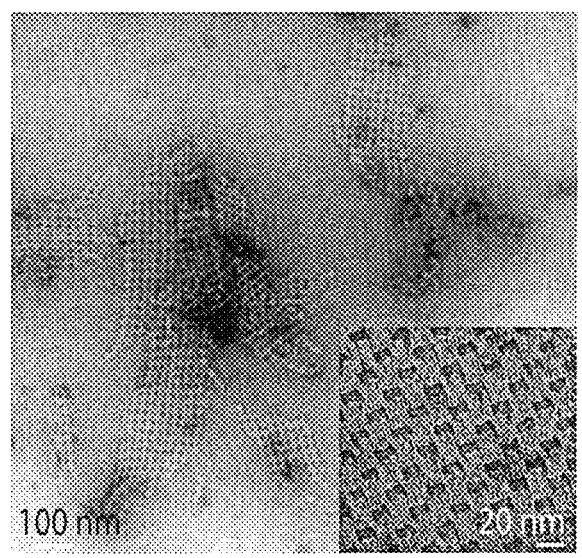
FIG. 33B shows TEM images of the offset-ZX-6H×6H×64B-cuboid crystal.
Figure 33C:
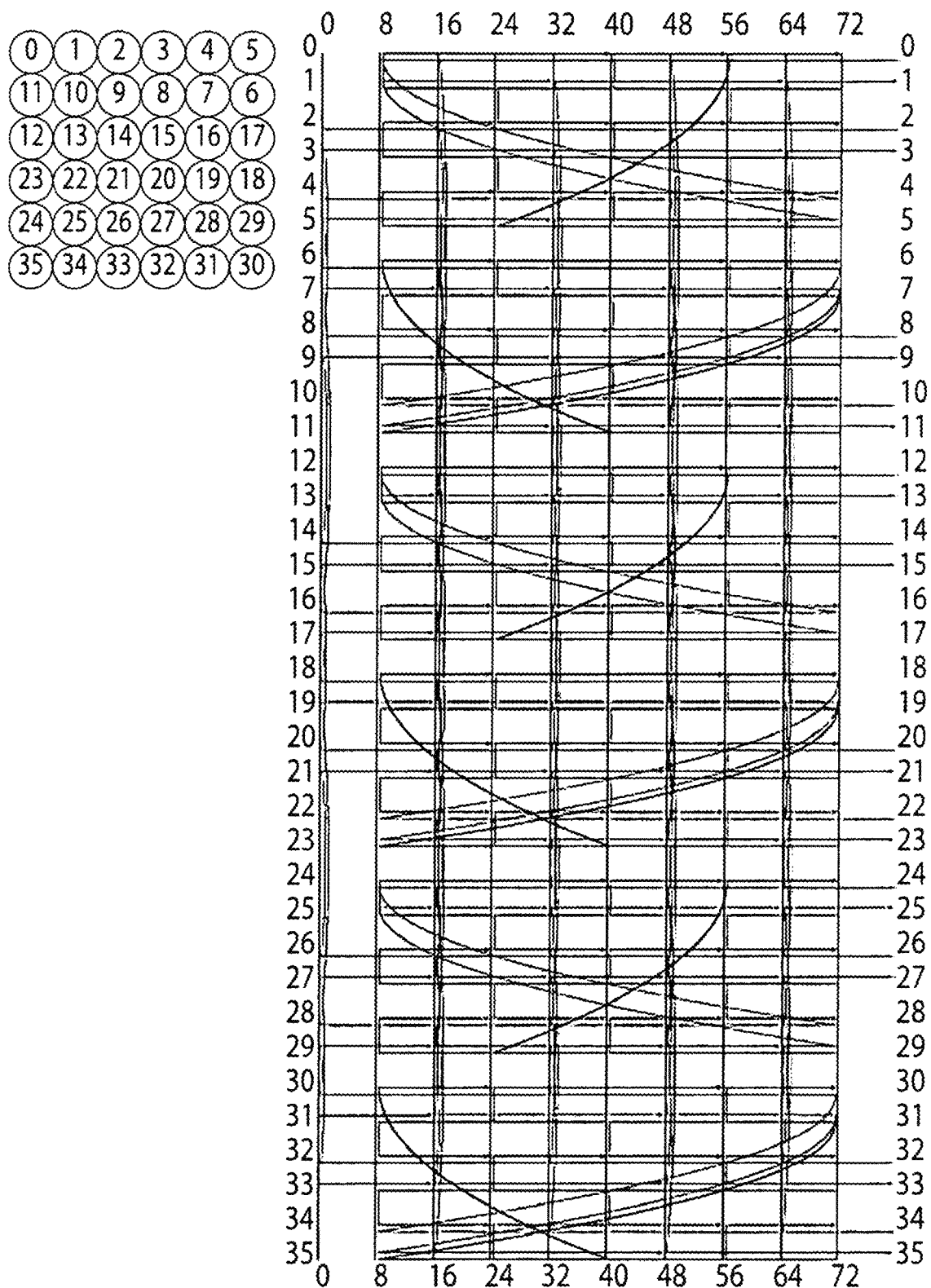
FIG. 33C shows a strand diagram of an offset-ZX-6H×6H×64B-cuboid crystal.

All of the foregoing crystals were designed using the connection scheme in FIG. 20B: extension of a structure was achieved by connecting the repeating units along an axis in a "perfect matching" fashion. For instance, in order to make a 6H×6H×32B-cuboid Z-axis crystal, every duplex in a repeating unit was designed to connect to the same duplex in the next repeating unit. However, connections along each axis can be shifted for generating "offset" crystals. Such strategy enables more crystal designs from a same basic repeating unit. We constructed a two-dimensional growth crystal that extended 6H×6H×64B-cuboid repeating units along the Z-axis and the X-axis using the offsetting scheme (FIGS. 33A-33C). In this design, the Z-axis extension of the crystal was shifted 4 duplexes along the X-axis; the X-axis extension of the crystal was shifted 32 bp along the Z-axis. The offset connections obeyed the following rules due to the periodicities of DNA-brick structures: shifting along X-axis or Y-axis occurred at 2-duplex intervals; and shifting along the Z-axis occurred at 32-bp intervals.

Example 5. Patterning Gold Nanoparticles

Figure 34A:
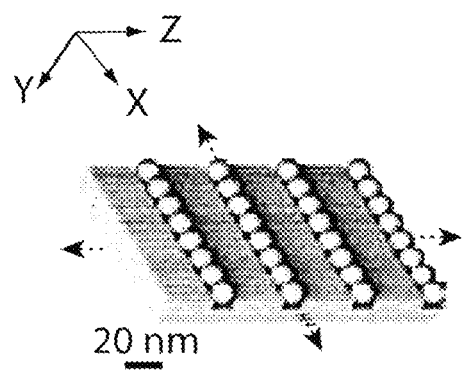
FIG. 34A shows a model of parallel lines of 10-nanometer gold nanoparticles closely packed on a ZX-4H×6H×96-channel crystal.
Figure 34B:
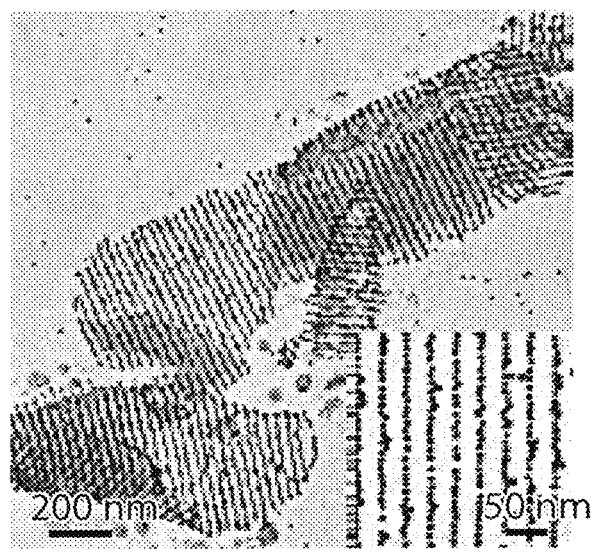
FIG. 34B shows a TEM image of parallel lines of 10-nanometer gold nanoparticles closely packed on a ZX-4H×6H×96-channel crystal.
Figure 34C:
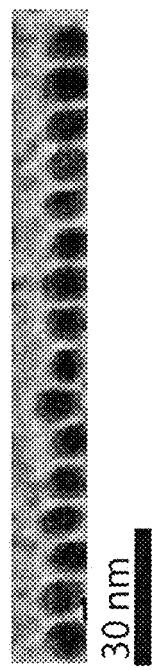
FIG. 34C shows a high-magnification TEM image of a single chain of gold nanoparticles.
Figure 34D:
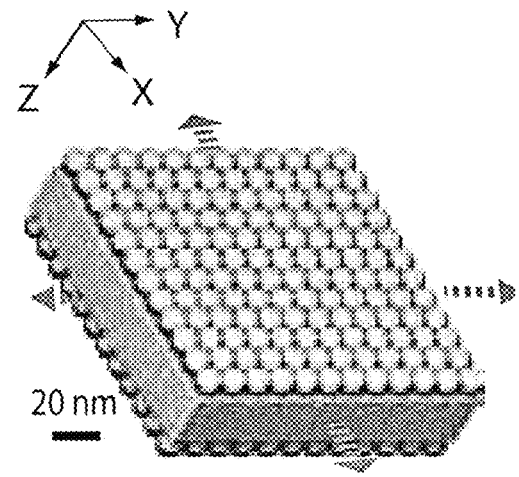
FIG. 34D shows a model of closely-packed gold nanoparticle monolayers that formed on the top surface and the bottom surface of a XY-4H×4H×64B-cuboid crystal.
Figure 34E:
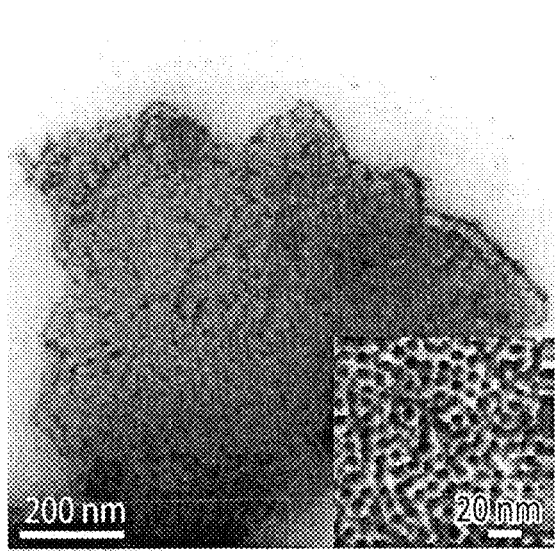
FIG. 34E shows a TEM image of closely-packed gold nanoparticle monolayers that formed on the top surface and the bottom surface of a XY-4H×4H×64B-cuboid crystal.
Figure 34F:
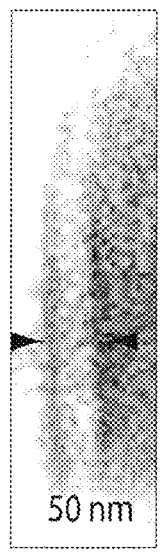
FIG. 34F shows a high-magnification TEM image a XY-4H×4H×64B-cuboid crystal with curvatures on the edge. Light gray arrows indicate curved positions where the two gold nanoparticle monolayers are visible.

Gold nanoparticles have been arranged into discrete patterns (Kuzyk, A. et al. *Nature* 483,311-314 (2012); Acuna, G P et al. *Science* 338,506-510 (2012); Aldaye, F A & Sleiman, H F. *Angew. Chem. Int. Ed.* 45,2204-2209 (2006)) and single-layer periodic patterns (Sharma, J. et al. *Science* 323,112-116 (2009)) using DNA structures as templates. However, it remains challenging to form closely-packed periodic patterns, especially multi-layer patterns, of gold nanoparticles. In order to demonstrate the use of the DNA-brick crystals for arranging materials, we designed and constructed closely-packed gold-nanoparticle structures: (1) a 2D arrangement of parallel gold-particle lines on a ZX-4H×6H×96-channel crystal (FIGS. 34A and 34B) and (2) a simple 3D arrangement of parallel gold-nanoparticle monolayers on the two surfaces of a XY-4H×4H×64-cuboid crystal (FIGS. 34C to 34E).

Figure 35A:
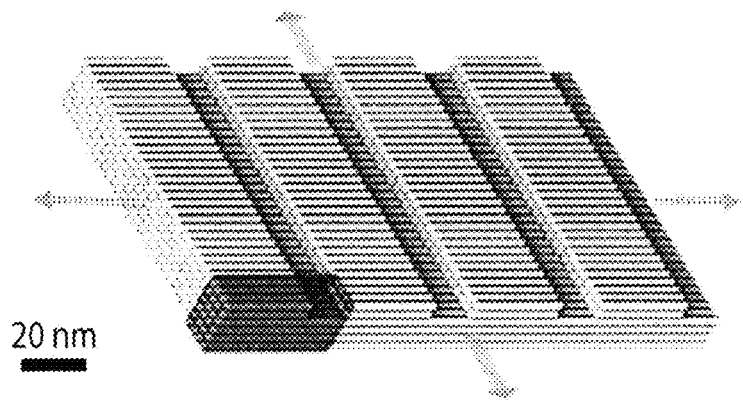
FIG. 35A shows the design of a ZX-4H×6H×96-channel crystal. The dark part represents a repeating unit.
Figure 35B:
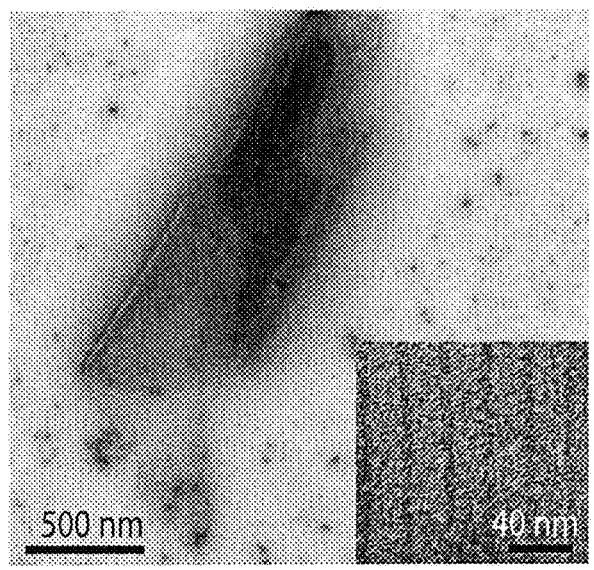
FIG. 35B shows a TEM image of the ZX-4H×6H×96-channel crystal.
Figure 35C:
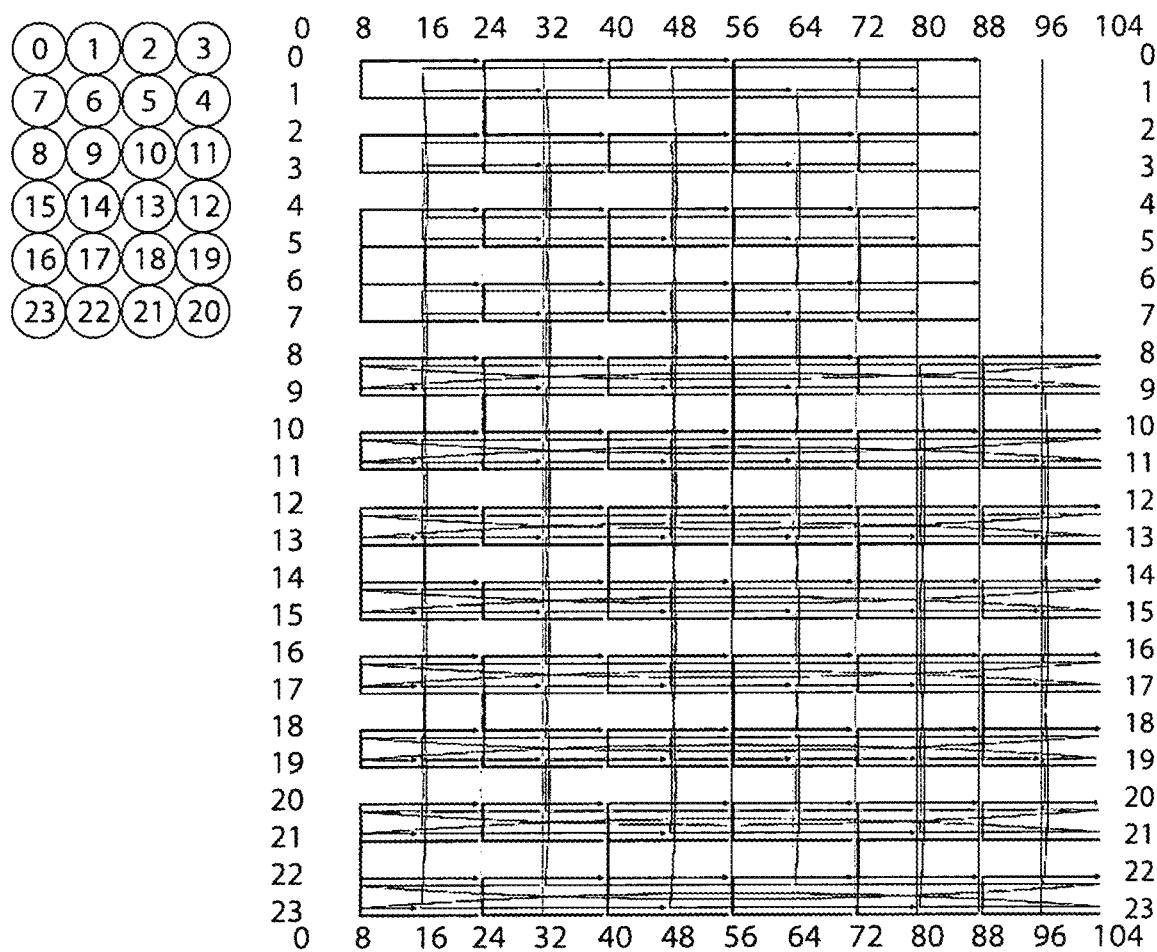
FIG. 35C shows a strand diagram of the ZX-4H×6H×96-channel crystal.

The design and TEM images of the ZX-4H×6H×96-channel crystal are shown in FIGS. 35A-35C. A channel is two-helix (5 nanometers) in depth and 32-bp (10.6 nanometers) in width. Neighboring parallel channels are separated by a 64-bp (21.2 nm) distance along the Z-axis. Gold nanoparticles functionalized with poly-A (ten consecutive adenine bases) DNA strands were arranged on the DNA crystals. Within the channels, every helix-end displays a poly-T single-stranded DNA for capturing the gold nanoparticles. The gold nanoparticles were successfully arranged into parallel lines consistent with our design. Within each line, a single chain of closely-packed gold nanoparticles was observed. The average distance between gold nanoparticles with a line is about 2 nanometers, except for some locations with clear defects (FIG. 34B). Two parallel gold-nanoparticle monolayers were assembled on the XY-4H×4H×64-cuboid crystal, as shown in FIG. 23C. The crystals displays poly-T sequences at each helix-end on both surfaces for capturing 10-nanometer gold nanoparticles functionalized with poly-A strands. The average distance between particles appeared to be about 1 to 2 nanometers (FIG. 34D). The structures sometimes curved on the edges (FIG. 34E). The edge-to-edge distance between the two monolayers of gold nanoparticles was measured to be about 25 nm, consistent with the designed crystal thickness.

Aligning gold nanoparticles into micron-scale ordered low-dimensional arrays is required in diverse plasmonic applica-tions (Melosh, N. A. et al. *Science* 300, 112-115 (2003); Qi, M. H. et al. *Nature* 429, 538-542 (2004)). In particular, nanoparticle arrays with less than 2 nm face-to-face spacing are expected to exhibit strong plasmonic coupling (Qi, M. H. et al., 2004). With DNA nanostructures as templates, gold nanoparticles have been arranged into chiral (Qi, M. H. et al., 2004), linear (Liu, N., et al. *Science* 332, 1407-1410 (2011); Tang, C. B., et al. *Science* 322, 429-432 (2008); Tavakkoli K. G., A. et al. *Science* 336, 1294-1298 (2012)), and branched patterns (Seeman, N.C. *J. Theor. Biol.* 99, 237-247 (1982); Chen, J. & Seeman, N. C. *Nature* 350, 631-633 (1991)). However, most of these structures are discrete sub-100 nm structures, which lack long-range ordering at micron scale. In addition, decreasing the interparticle spacing down to 2 nm is also challenging. Methods of producing DNA crystals of the invention provide a unique way to address these challenges. By varying the surface distribution of poly-T binding sites, gold nanoparticles were programmed with different 2D patterns at micron scale, from close-packing patterns to arrays of gold nanoparticle chain with 20-nm inter-chain spacing. The periodicity of poly-T binding site is 2.5 nm on DNA crystals, which reduced the inter-particle spacing to about 2 nm.

Our work presents generalized approaches to construct 3D square-lattice, honeycomb-lattice, and hexagonal-lattice DNA nanostructures from short synthetic DNA. Furthermore, we also demonstrated 102 intricate 3D shapes with diverse shapes and intricate features such as channels and pores. Our modular approach, accompanied by our simplified LEGO®-like model and computer-aided design process, provides a simple method for designing intricate 3D nanostructures. Because of the absence of the long scaffold strand, any voxel in a 3D canvas can be added or removed independently, allowing us to design shapes with 8 bp resolution. Taking advantage of the compactness and modularity of DNA bricks, we were able to assemble nanostructures with intricate features (such as thin cavities and passages) that may be difficult to achieve using DNA origami, where each staple strand component typically is much less compact and the scaffold is not modular at all. An 1000-voxel 3D DNA canvas provides up to $2^{1000}$~$10^{300}$ potential possibilities. However, each voxel must physically be connected to at least one of its neighboring voxels in order to self-assemble a complete shape. So the actual shapes that can be constructed are fewer.

We noticed that certain large or intricate designs may exhibit fragility. One example is the 3H×3H×1024B, which mostly broke into segments during TEM imaging after agarose-gel purification. One way to address this issue is through incorporation of longer synthetic DNA strands to some positions, especial to "weak points," of a nanostructure. These long strands may strengthen the shapes, like the scaffold strand does.

The ability to construct intricate 3D shapes will extend the range of challenges and applications that DNA nanotechnology can addresses, e.g. to make sophisticated DNA devices to mimic biosynthetic machineries, or to arrange guest molecules in 3D space to generate a variety of functional nanomaterials. In addition, 3D nanostructures made from synthetic DNA will allow researchers to design custom sequences tailored to their applications. Further, modular self-assembly using other synthetic informational polymers, including L-DNA, DNA with chemically modified backbones, DNA with artificial bases, and RNA may prove crucial for a variety of applications, such as drug delivery and therapeutic applications.

We have also provided a general methodology for constructing complex 3D DNA crystals with custom designed dimensions and nanoscale features. This is the first bottom-up self-assembly strategy that is capable of making genuine microscale 3D periodic structures, which can reach megadalton in size using repeating units that can be rationally designed at a few nanometers resolution. Using a variety of designs of periodic units—from a few hundred base pairs to several thousand base pairs—we constructed (1) 1D-growth DNA-bundle crystals that contain up to 108 parallel helices; (2) 2D-growth DNA multilayer crystals that are up to 20 layers (50 nm) in thickness; and (3) 2D-growth DNA-forest crystals that are up to 256 bp (84 nm) in height. Moreover, we demonstrated that complex nanometer scale surface features, channels, and porous patterns can be realized in the 3D crystals provided herein.

This assembly strategy is based on an understanding of DNA-origami and DNA-tile crystallization. Assembly of DNA-origami crystals herein may be carried out using a one-step-annealing reaction or a two-step-annealing reaction. In the one-annealing reaction, the scaffold, 5- to 10-fold staples, and connecting strands are annealed together. Without being bound by theory, it is believed that the DNA origami monomers have to formed correctly at earlier stages (at higher temperatures) of the annealing and then join with each other at later stages of annealing (at lower temperatures) to form crystals. The two-step-annealing reaction starts with an initial annealing of origami monomer excluding the connecting strands, followed by a purification step to obtain the origami monomers. The purified monomers are then mixed with connecting strands, and the mixture is subjected to a second annealing at a starting temperature lower than the first annealing step. In both cases, the assembly of DNA-origami crystals is a hierarchical process with two separate stages: monomer formation and crystallization of monomers.

Such a hierarchical crystallization may pose a few potential challenges. First, the formation of monomers and the crystallization may have to happen at two well-separated annealing stages. If the crystallization starts before the monomers are fully formed, it may be possible that defective monomers will compromise the growth of some well-ordered crystals. Second, the kinetics of incorporating a DNA origami monomer to a crystal may be slow because of the sheer size of the monomer and the large amount of negative charge of the monomer. These factors may prevent a crystal from reaching a large size within a reasonable annealing time. Third, successful crystallization may require some error-correction that involves re-occurring monomer incorporation and dissociation that eventually may result in the system reaching the lowest energy state. For a large origami monomer, the dissociation rate may be slow, which either may lead to defects in some crystals or may hinder crystal growth.

The DNA-brick crystal framework provided herein reveals a new perspective for making complex DNA crystals in three-dimensional space: fast kinetics during crystallization can be achieved without compromising informational complexity of the repeating units. Using a modular strategy that utilizes standardized components—like the DNA bricks—a repeating unit can contain thousands of base pairs, enabling complex designs in 3D space. Crystals grow through incorporation of individual bricks during DNA-brick crystallization, without the need to first form a multi-strand unit. Therefore, both the information complexity and fast kinetics for crystallization are realized in the modular DNA-brick crystals of the invention.

Rationally-designed, self-assembled DNA crystals of the invention may be used for templating functional moieties such as, but not limited to, proteins, nucleic acids, metallic particles, quantum dots, etc. Such a bottom-up approach can be used to fabricate micron-scaled periodic materials with nanoscale features. This technology facilitates arranging DNA crystals using top-down patterning, thus achieving one of the important goals of nanotechnology—combining efficient nanoscale DNA self-assembly with powerful top-down approaches for applications such as, for example, nanophotonics and nanoelectronics.

Methods and Materials

Sample Preparation.

DNA strands were synthesized by Integrated DNA Technology, Inc. or Bioneer Corporation. To assemble the structures, unpurified DNA strands were mixed to a final concentration of 100 nM or 200 nM per strand (for a nanostructure that contains more than 500 strands, an evaporation step was performed to achieve desired 200 nM concentration) in 0.5×TE buffer (5 mM Tris, pH 7.9, 1 mM EDTA) supplemented with 10 to 80 mM $MgCl_2$.

Annealing Ramps.

The strand mixture was then annealed in a PCR thermo cycler by a fast linear cooling step from 80° C. to 60° C. over 1 hour, then a 24 hour or 72 hour linear cooling ramp from 60° C. to 24° C. The annealing ramps were named according to length of the second cooling step, as 24-hour annealing or 72-hour annealing.

Agarose Gel Electrophoresis and Sample Purification.

Annealed samples were then subjected to 2 percent native agarose gel electrophoresis for 2 hours (gel prepared in 0.5×TBE buffer supplemented with 11 mM $MgCl_2$ and 0.005% (v/v) EtBr) in an ice water bath. Then, the target gel bands were excised and placed into a Freeze'N Squeeze column (Bio-Rad Laboratories, Inc.). The gel pieces were crushed into fine pieces by a microtube pestle in the column, and the column was then centrifuged at 7000 g for 5 minutes. Samples that were extracted through the column were collected for TEM or AFM imaging.

Robot Automation for Sample Preparation.

A Python program was designed to aid complex shapes design and automate strand mixing by using a liquid handling robot (Bravo, Agilent). For each shape, 4 µL of 10 µM of each strand in water solution was pipetted and mixed into a final volume of less than 2 mL (the exact volume was determined by the number of constituent strands for the target shape). The mixture was then vacufuge-dried (Savant Speedvac sc110) and resuspended in 200 µL 0.5×TE buffer with 40 mM $MgCl_2$. Each round of robot pipetting accommodated 48 shapes and took three to four days to complete.

Tem Imaging.

For imaging, 3.5 µL agarose-gel-purified or unpurified sample were adsorbed for 4 minutes onto glow discharged carbon-coated TEM grids and stained for 1 minute using a 2% aqueous uranyl formate solution containing 25 mM NaOH. Imaging was performed using a JEOL JEM-1400 operated at 80 kV.

AFM Imaging.

AFM images were obtained using an SPM Multimode with Digital Instruments Nanoscope V controller (Veeco). 5 µL of purified, annealed sample with purification followed by 40 µL of 0.5×TE (10 mM $MgCl_2$) was applied onto the surface of a freshly cleaved mica and left for approximately 2 minutes to allow for absorption. Dilution of the sample was sometimes performed to achieve the desired mica surface coverage. The AFM tips used were the short and thin cantilevers in the SNL-10 silicon nitride cantilever chip (Veeco Probes).

Methods and Materials for Crystal Growth Experiments.

Sample Preparation.

DNA strands were synthesized by Integrated DNA Technology, Inc. or Bioneer Corporation. To assemble the structures, unpurified DNA strands were mixed in an equimolar stoichiometric ratio to the highest possible concentration from a 100 µM stock in 0.5×TE buffer (5 mM Tris, pH 7.9, 1 mM EDTA) supplemented with 40 mM $MgCl_2$ or 60 mM $MgCl_2$.

Annealing Ramps.

The strand mixture was then annealed in a PCR thermo cycler by a fast linear cooling step from 80° C. to 60° C. over 1 hour, then a 72 hours or 168 hours linear cooling ramp from 60° C. to 24° C. The annealing ramps were named according to length of the second cooling step, as 72-hour annealing or 168-hour annealing.

Tem Imaging.

For imaging, 2.5 µL of annealed sample were adsorbed for 2 minutes onto glow-discharged, carbon-coated TEM grids. The grids were then stained for 10 seconds using a 2% aqueous uranyl formate solution containing 25 mM NaOH. Imaging was performed using a JEOL JEM-1400 TEM operated at 80 kV.

DNA-Decoration onto 10-nm Gold Nano-Particles.

Conjugation of thiolated DNA onto 10-nm gold nano-particles was achieved as previously described (Sharma, J. et al. *J. Am. Chem. Soc.* 130, 7820-7821, (2008)). In a typical experiment, 20 µL 2.5 µM phosphine-coated 10-nm gold nanoparticle was mixed with 0.5 µL 2 M NaNO3 and 0.65 µL 100 µM thiolated DNA in 0.25×TBE buffer. The reaction solution was incubated at room temperature for 36 hours in dark. After that, the reaction solution was loaded into 1% agarose gel containing 0.5×TBE buffer. The electrophoresis was running at 95 V for 1 hour in a gel box on an ice-water bath. The purple band was recovered by pestle crushing, followed by centrifugation for 3 min at 10,000 rpm at room temperature using "Freeze 'N Squeeze" DNA Gel Extraction spin columns (Bio-Rad). Recovered DNA molds were stored at 4° C. in the dark for further use. The sequence for the thiolated DNA was: 5'-AAAAAAAAAA-/3ThioMC3-D/.

Gold Nano Particle Decoration.

To 15 μL 400 mM NaCl solution, 0.8 μL (ZX-4H×6H×96B-channel crystal) or 0.6 μL (XY-4H×4H×64B-cuboid crystal) DNA samples were added. Then, 0.2 uL 95 nM 10 nm gold nanoparticles were introduced. After pipetting for 50 times, the reaction mixture was left at room temperature for three hours in the dark.

TABLE 2

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

1, 517, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 72, 73, 74, 75, 76, 77, 78, 79, 80, 81, 82, 83, 84, 85, 86, 87, 91, 93, 94, 95, 96, 97, 98, 99, 100, 101, 102, 103, 104, 105, 106, 107, 108, 109, 112, 113, 115, 117, 118, 119, 120, 121, 122, 123, 124, 125, 126, 127, 128, 129, 130, 131, 132, 136, 138, 139, 140, 141, 142, 143, 144, 145, 146, 147, 148, 149, 150, 151, 152, 153, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3707, 3789, 1305, 1307, 1309, 1312, 1319, 1322, 1329, 1332, 1339, 1342, 1349, 1357, 1361, 1365, 1369, 1373, 1375, 1379, 1383, 1387, 1391, 1393, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

2, 504, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 72, 73, 74, 75, 76, 77, 78, 79, 80, 81, 82, 83, 84, 85, 86, 87, 95, 96, 97, 98, 99, 100, 101, 102, 103, 104, 105, 106, 107, 108, 109, 112, 113, 115, 117, 118, 119, 120, 121, 122, 123, 124, 125, 126, 127, 129, 131, 132, 136, 138, 139, 140, 141, 142, 143, 144, 145, 146, 147, 148, 149, 150, 151, 152, 153, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2747, 3018, 3036, 3038, 3056, 3058, 3076, 3078, 3096, 3227, 3707, 3789, 675, 1088, 1305, 1307, 1309, 1312, 1319, 1329, 1335, 1339, 1342, 1349, 1357, 1361, 1365, 1369, 1373, 1375, 1379, 1383, 1387, 1391, 1393, 3973, 3976, 4037, 4039, 4289, 4346, 4350, 3826, 3859, 3861, 3862, 3894, 3896, 3897, 3898, 3929, 3931, 3933, 3934, 3966, 3968, 4001, 4003, 4005, 4006, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

3, 492, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 71, 72, 73, 74, 75, 76, 77, 78, 79, 80, 81, 82, 83, 84, 85, 86, 87, 95, 96, 97, 98, 99, 100, 101, 102, 103, 104, 105, 107, 109, 117, 118, 119, 120, 121, 122, 123, 124, 125, 126, 127, 129, 131, 132, 136, 138, 139, 140, 141, 142, 143, 144, 145, 146, 147, 148, 149, 150, 151, 152, 153, 154, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 279, 280, 281, 282, 283, 284, 285, 286, 287, 288, 289, 290, 291, 292, 293, 294, 295, 296, 297, 298, 299, 300, 306, 307, 308, 309, 310, 311, 312, 313, 314, 315, 316, 317, 318, 319, 320, 321, 322, 323, 324, 325, 326, 327, 328, 329, 336, 337, 338, 339, 340, 341, 342, 343, 344, 345, 346, 347, 348, 349, 350, 351, 352, 353, 354, 355, 356, 357, 358, 359, 366, 367, 368, 369, 370, 371, 372, 373, 374, 375, 376, 377, 378, 379, 380, 381, 382, 383, 384, 385, 386, 387, 388, 389, 395, 396, 397, 398, 399, 400, 401, 402, 403, 404, 405, 406, 407, 408, 409, 410, 411, 412, 413, 414, 415, 416, 417, 418, 419, 420, 421, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2747, 2833, 3018, 3036, 3038, 3056, 3058, 3076, 3078, 3096, 3227, 3317, 3707, 3789, 675, 716, 1045, 1088, 1126, 1305, 1307, 1309, 1312, 1319, 1335, 1339, 1342, 1349, 1357, 1361, 1365, 1369, 1373, 1375, 1379, 1383, 1387, 1391, 1393, 3973, 3976, 4002, 4004, 4007, 4010, 4037, 4039, 4257, 4289, 4318, 4346, 4350, 3826, 3859, 3861, 3862, 3894, 3896, 3897, 3898, 3929, 3931, 3933, 3966, 3968, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

4, 480, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 71, 72, 73, 74, 75, 76, 77, 78, 79, 80, 81, 82, 83, 84, 85, 86, 96, 98, 99, 100, 101, 102, 103, 104, 105, 107, 109, 117, 118, 119, 120, 121, 122, 123, 124, 125, 126, 127, 136, 138, 140, 141, 142, 143, 144, 145, 146, 147, 148, 149, 150, 151, 152, 153, 154, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 279, 280, 281, 282, 283, 284, 285, 286, 287, 288, 289, 290, 291, 292, 293, 294, 295, 296, 297, 298, 299, 300, 306, 307, 308, 309, 310, 311, 312, 313, 314, 315, 316, 317, 318, 319, 320, 321, 322, 323, 324, 328, 336, 337, 338, 339, 340, 341, 342, 343, 344, 345, 346, 347, 348, 349, 350, 351, 352, 353, 354, 355, 356, 357, 358, 359, 366, 367, 368, 369, 370, 371, 372, 373, 374, 375, 376, 377, 378, 379, 380, 381, 382, 383, 395, 396, 397, 398, 399, 400, 401, 402, 403, 404, 405, 406, 407, 408, 409, 410, 411, 412, 413, 414, 415, 416, 417, 418, 419, 420, 421, 423, 424, 425, 426, 427, 428, 429, 430, 431, 432, 433, 434, 435, 436, 437, 438, 439, 440, 441, 442, 443, 444, 445, 447,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2556, 2747, 2761, 2833, 3018, 3036, 3038, 3056, 3058, 3076, 3078, 3096, 3227, 3317, 3707, 3789, 716, 751, 1045, 1077, 1088, 1126, 1158, 1305, 1307, 1309, 1312, 1319, 1335, 1339, 1342, 1349, 1357, 1361, 1365, 1369, 1373, 1375, 1379, 1383, 1387, 1391, 1393, 3972, 3975, 4002, 4004, 4007, 4010, 4031, 4035, 4257, 4281, 4289, 4318, 4342, 4346, 4350, 3826, 3859, 3861, 3862, 3894, 3896, 3897, 3898, 3929, 3931, 3933, 3966, 3968, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
5, 467, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 72, 73, 74, 75, 76, 77, 78, 79, 80, 81, 82, 83, 84, 85, 86, 96, 98, 99, 100, 101, 102, 103, 104, 109, 118, 120, 122, 123, 124, 125, 126, 127, 136, 138, 140, 141, 142, 143, 144, 145, 146, 147, 148, 149, 150, 151, 152, 153, 154, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 279, 280, 281, 282, 283, 284, 285, 286, 287, 288, 289, 290, 291, 292, 293, 294, 296, 298, 299, 300, 306, 307, 308, 309, 310, 311, 312, 313, 314, 315, 316, 317, 318, 319, 320, 321, 322, 323, 324, 328, 336, 337, 338, 339, 340, 341, 342, 343, 344, 345, 346, 347, 348, 349, 350, 351, 352, 353, 366, 367, 368, 369, 370, 371, 372, 373, 374, 375, 376, 377, 378, 379, 380, 381, 382, 383, 395, 396, 397, 398, 399, 400, 401, 402, 403, 404, 405, 406, 407, 408, 409, 410, 411, 412, 413, 419, 420, 421, 423, 424, 425, 426, 427, 428, 429, 430, 431, 432, 433, 434, 435, 436, 437, 438, 439, 440, 441, 442, 443, 444, 445, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2556, 2747, 2761, 2827, 2833, 3018, 3036, 3038, 3056, 3058, 3076, 3078, 3096, 3227, 3317, 3707, 3789, 722, 751, 1045, 1077, 1088, 1126, 1158, 1305, 1307, 1309, 1312, 1319, 1335, 1337, 1339, 1342, 1349, 1357, 1361, 1365, 1369, 1373, 1375, 1379, 1383, 1387, 1391, 1393, 3972, 3975, 3993, 3997, 4009, 4012, 4031, 4035, 4257, 4281, 4289, 4309, 4313, 4318, 4342, 4346, 4350, 4370, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
6, 453, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 72, 73, 74, 75, 76, 77, 78, 79, 80, 81, 82, 84, 85, 86, 100, 101, 102, 103, 104, 109, 118, 120, 122, 124, 126, 127, 136, 138, 141, 142, 143, 144, 145, 146, 147, 148, 149, 150, 151, 152, 153, 154, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 278, 280, 281, 282, 283, 284, 285, 286, 287, 288, 289, 290, 291, 292, 293, 294, 296, 298, 299, 300, 306, 307, 308, 309, 310, 311, 312, 313, 314, 315, 316, 317, 318, 319, 320, 321, 322, 323, 324, 328, 342, 343, 344, 345, 346, 347, 348, 349, 350, 351, 352, 353, 366, 367, 368, 369, 370, 371, 372, 373, 374, 375, 376, 377, 378, 379, 380, 381, 382, 383, 395, 401, 402, 403, 404, 405, 406, 407, 408, 409, 410, 411, 412, 413, 419, 420, 421, 423, 424, 425, 426, 427, 428, 429, 430, 431, 432, 433, 434, 435, 436, 437, 438, 439, 440, 441, 442, 443, 444, 445, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2538, 2556, 2747, 2761, 2767, 2827, 2833, 3018, 3036, 3038, 3056, 3058, 3076, 3078, 3096, 3227, 3317, 3707, 3789, 685, 722, 1045, 1077, 1088, 1126, 1158, 1305, 1307, 1309, 1312, 1319, 1335, 1337, 1339, 1342, 1349, 1357, 1361, 1365, 1369, 1373, 1375, 1379, 1383, 1387, 1391, 1393, 3980, 3984, 3993, 3997, 4009, 4012, 4029, 4033, 4257, 4281, 4289, 4291, 4295, 4309, 4313, 4318, 4342, 4346, 4350, 4352, 4356, 4370, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
7, 441, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 73, 74, 75, 76, 77, 78, 79, 80, 81, 82, 84, 85, 86, 100, 102, 104, 122, 124, 126, 127, 136, 138, 141, 142, 143, 144, 145, 146, 147, 148, 149, 150, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 278, 280, 281, 282, 283, 284, 285, 286, 287, 288, 289, 290, 291, 292, 293, 294, 296, 298, 299, 300, 306, 310, 312, 313, 314, 315, 316, 317, 318, 319, 320, 321, 322, 323, 324, 328, 342, 343, 344, 345, 346, 347, 348, 349, 350, 351, 352, 353, 372, 373, 374, 375, 376, 377, 378, 379, 380, 381, 382, 383, 395, 401, 402, 403, 404, 405, 406, 407, 408, 409, 410, 411, 412, 413, 419, 420, 421, 423, 424, 425, 426, 427, 429, 430, 431, 432, 433, 434, 435, 436, 437, 438, 439, 440, 441, 442, 443, 444, 445, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2538, 2556, 2747, 2761, 2767, 2821, 2827, 2833, 3018, 3036, 3038, 3056, 3058, 3076, 3078, 3096, 3227, 3317, 3707, 3789, 685, 706, 1045, 1053, 1077, 1088, 1126, 1134, 1158, 1305, 1307, 1309, 1312, 1319, 1335, 1337, 1339, 1342, 1349, 1357, 1361, 1365, 1369, 1373, 1375, 1379, 1383, 1387, 1391, 1393, 3980, 3984, 3995, 3999, 4014, 4018, 4029, 4033, 4257, 4263, 4281, 4289, 4291, 4295, 4309, 4313, 4318, 4324, 4342, 4346, 4350, 4352, 4356, 4370, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
8, 429, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 73, 74, 75, 76, 77, 78, 79, 80, 81, 84, 85, 86, 104, 122, 136, 138, 141, 142, 143, 145, 146, 147, 148, 149, 150, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 278, 280, 281, 282, 283, 284, 285, 286, 287, 288, 289, 290, 291, 292, 293, 294, 296, 298, 299, 300, 306, 310, 312, 313, 314, 315, 316, 317, 318, 322, 324, 328, 342, 343, 344, 345, 346, 347, 348, 349, 350, 351, 352, 353, 372, 373, 374, 375, 376, 377, 395, 401, 402, 403, 404, 405, 406, 407, 408, 409, 410, 411, 412, 413, 419, 420, 421, 423, 424, 425, 426, 427, 429, 430, 431, 432, 433, 434, 435, 436, 437, 438, 439, 441, 442, 443, 444, 445, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2536, 2538, 2556, 2747, 2761, 2767, 2781, 2821, 2827, 2833, 3018, 3036, 3038, 3056, 3058, 3076, 3078, 3096, 3227, 3317, 3707, 3789, 706, 741, 1045, 1053, 1069, 1077, 1088, 1126, 1134, 1150, 1158, 1305, 1307, 1309, 1312, 1319, 1335, 1337, 1339, 1342, 1349, 1357, 1361, 1365, 1369, 1373, 1375, 1379, 1383, 1387, 1391, 1393, 3978, 3982, 3995, 3999, 4014, 4018, 4023, 4027, 4257, 4263, 4275, 4281, 4289, 4291, 4295, 4309, 4313, 4318, 4324, 4336, 4342, 4346, 4350, 4352, 4356, 4370, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
9, 419, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 77, 78, 79, 80, 81, 84, 85, 86, 104, 136, 138, 141, 142, 143, 145, 146, 147, 148, 149, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 278, 280, 281, 282, 283, 284, 285, 286, 287, 288, 290, 292, 293, 294, 296, 298, 299, 300, 306, 310, 312, 313, 314, 315, 316, 317, 318, 322, 324, 328, 342, 343, 344, 345, 346, 347, 372, 373, 374, 375, 376, 377, 395, 401, 402, 403, 404, 405, 406, 407, 413, 419, 420, 421, 423, 424, 425, 426, 427, 429, 430, 431, 432, 433, 434, 435, 436, 437, 438, 439, 441, 442, 443, 444, 445, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2536, 2538, 2556, 2747, 2761, 2767, 2781, 2807, 2821, 2827, 2833, 3018, 3036, 3038, 3056, 3058, 3076, 3078, 3096, 3227, 3317, 3707, 3789, 697, 701, 732, 741, 745, 749, 1045, 1053, 1069, 1077, 1088, 1126, 1134, 1150, 1158, 1305, 1307, 1309, 1312, 1319, 1335, 1337, 1339, 1342, 1349, 1357, 1361, 1365, 1369, 1373, 1375, 1379, 1383, 1387, 1391, 1393, 1978, 3982, 4016, 4020, 4257, 4263, 4275, 4281, 4289, 4291, 4295, 4303, 4307, 4309, 4313, 4318, 4324, 4336, 4342, 4346, 4350, 4352, 4356, 4364, 4368, 4370, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
10, 503, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 72, 74, 75, 76, 77, 79, 80, 81, 82, 84, 85, 86, 87, 91, 93, 94, 96, 97, 98, 99, 101, 102, 103, 104, 106, 107, 108, 109, 112, 115, 117, 119, 120, 121, 122, 124, 125, 126, 127, 129, 130, 131, 132, 136, 138, 139, 141, 142, 143, 144, 146, 147, 148, 149, 151, 152, 153, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 332, 333, 334, 335, 337, 338, 339, 340, 341, 343, 344, 345, 346, 347, 349, 350, 351, 352, 353, 355, 356, 357, 358, 359, 362, 363, 364, 365, 367, 368, 369, 370, 371, 373, 374, 375, 376, 377, 379, 380, 381, 382, 383, 385, 386, 387, 388, 389, 391, 392, 393, 394, 395, 397, 398, 399, 400, 401, 403, 404, 405, 406, 407, 409, 410, 411, 412, 413, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2498, 2518, 2538, 2747, 2767, 2787, 2807, 2827, 3018, 3036, 3038, 3056, 3058, 3076, 3078, 3096, 3227, 3387, 3466, 3707, 3789, 1305, 1307, 1309, 1312, 1319, 1325, 1327, 1335, 1337, 1339, 1342, 1349, 1357, 1361, 1365, 1369, 1373, 1375, 1379, 1383, 1387, 1391, 1393, 1576, 1586, 1596, 1606, 1616, 1622, 1632, 1642, 1652, 3826, 3859, 3861, 3862, 3894, 3896, 3897, 3898, 3929, 3931, 3933, 3934, 3966, 3968, 3970, 4003, 4005, 4006, 4038, 4040, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
11, 488, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 91, 93, 96, 97, 98, 101, 102, 103, 106, 107, 108, 115, 116, 119, 120, 121, 124, 125, 126, 129, 130, 131, 134, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 306, 307, 308, 309, 310, 312, 313, 314, 315, 316, 318, 319, 320, 321, 322, 324, 325, 326, 327, 328, 332, 333, 334, 337, 338, 339, 340, 343, 344, 345, 346, 349, 350, 351, 352, 355, 356, 357, 358, 362, 363, 367, 368, 369, 370, 373, 374, 375, 376, 379, 380, 381, 382, 385, 386, 387, 388, 391, 392, 393, 395, 397, 398, 399, 400, 401, 403, 404, 405, 406, 407, 409, 410, 411, 412, 413, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3317, 3387, 3466, 3477, 3560, 3707, 3789, 1305, 1307, 1309, 1312, 1319, 1325, 1327, 1335, 1337, 1339, 1342, 1349, 1357, 1361, 1365, 1369, 1373, 1375, 1383, 1387, 1391, 1393, 1576, 1583, 1586, 1593, 1596, 1603, 1606, 1613, 1616, 1619, 1622, 1629, 1632, 1639, 1642, 1649, 1652, 1659, 3826, 3859, 3861, 3862, 3894, 3896, 3897, 3898, 3929, 3931, 3933, 3966, 3968, 3970, 4003, 4005, 4038, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
12, 479, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 91, 93, 96, 97, 98, 101, 102, 103, 106, 107, 108, 115, 116, 119, 120, 121, 124, 125, 126, 129, 130, 131, 134, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 306, 307, 308, 309, 310, 312, 313, 314, 315, 316, 318, 319, 320, 321, 322, 324, 325, 326, 327, 328, 332, 333, 337, 338, 339, 343, 344, 345, 349, 350, 351, 355, 356, 357, 362, 363, 367, 368, 369, 373, 374, 375, 379, 380, 381, 385, 386, 387, 391, 392, 393, 395, 397, 398, 399, 400, 401, 403, 404, 405, 407, 409, 410, 411, 413, 415, 416, 417, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3317, 3387, 3397, 3413, 3429, 3445, 3461, 3466, 3560, 3576, 3592, 3608, 3624, 3707, 3789, 1305, 1307, 1309, 1312, 1319, 1325, 1327, 1335, 1337, 1339, 1342, 1349, 1357, 1361, 1365, 1369, 1373, 1375, 1379, 1383, 1387, 1391, 1393, 1576, 1586, 1596, 1606, 1616, 1622, 1632, 1642, 1652, 2031, 2039, 2047, 2055, 2063, 3826, 3859, 3861, 3862, 3894, 3896, 3897, 3898, 3929, 3931, 3933, 3966, 3968, 3970, 4003, 4005, 4038, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

13, 470, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 91, 93, 96, 97, 98, 101, 102, 103, 106, 107, 108, 115, 116, 119, 120, 121, 124, 125, 126, 129, 130, 131, 134, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 273, 274, 275, 276, 277, 278, 279, 280, 281, 282, 283, 284, 285, 286, 287, 288, 289, 290, 291, 292, 293, 294, 295, 296, 297, 298, 299, 300, 302, 303, 306, 308, 309, 310, 312, 314, 315, 316, 318, 320, 321, 322, 324, 326, 327, 328, 332, 333, 338, 339, 344, 345, 350, 351, 356, 357, 362, 363, 368, 369, 374, 375, 380, 381, 386, 387, 391, 392, 393, 395, 397, 398, 399, 401, 403, 404, 405, 407, 409, 410, 411, 413, 415, 416, 417, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3307, 3317, 3323, 3339, 3355, 3371, 3397, 3413, 3429, 3445, 3461, 3466, 3482, 3498, 3514, 3530, 3560, 3576, 3592, 3608, 3624, 3707, 3789, 1305, 1307, 1309, 1312, 1319, 1325, 1327, 1335, 1337, 1339, 1342, 1349, 1357, 1361, 1365, 1369, 1373, 1375, 1379, 1383, 1387, 1391, 1393, 1986, 1994, 2002, 2010, 2018, 2031, 2039, 2047, 2055, 2063, 3826, 3859, 3861, 3862, 3894, 3896, 3897, 3898, 3929, 3931, 3933, 3966, 3968, 3970, 4003, 4005, 4038, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
14, 455, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 91, 92, 96, 97, 101, 102, 106, 107, 111, 115, 119, 120, 124, 125, 129, 130, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 280, 281, 282, 283, 284, 286, 287, 288, 289, 290, 292, 293, 294, 295, 296, 298, 299, 300, 302, 306, 308, 309, 310, 312, 314, 315, 316, 318, 320, 321, 322, 324, 326, 327, 328, 332, 338, 339, 344, 345, 350, 351, 356, 357, 362, 363, 368, 369, 374, 375, 380, 381, 386, 387, 391, 392, 395, 397, 398, 401, 403, 404, 407, 409, 410, 413, 415, 416, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3307, 3316, 3317, 3323, 3339, 3355, 3371, 3393, 3466, 3482, 3498, 3514, 3530, 3707, 3789, 1305, 1307, 1309, 1312, 1319, 1325, 1327, 1335, 1337, 1339, 1342, 1349, 1357, 1361, 1365, 1369, 1373, 1375, 1379, 1383, 1387, 1391, 1591, 1601, 1611, 1627, 1637, 1647, 1657, 1663, 1986, 1994, 2002, 2010, 2018, 4289, 4295, 4301, 4307, 4313, 4350, 4356, 4362, 4368, 4374, 3826, 3859, 3861, 3862, 3894, 3896, 3897, 3898, 3929, 3931, 3933, 3966, 3968, 4005, 4038, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
15, 450, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 92, 97, 102, 107, 111, 115, 120, 125, 130, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 280, 281, 282, 283, 284, 286, 287, 288, 289, 290, 292, 293, 294, 295, 296, 298, 299, 300, 302, 306, 308, 309, 310, 312, 314, 315, 316, 318, 320, 321, 322, 324, 326, 327, 328, 338, 339, 344, 345, 350, 351, 356, 357, 363, 368, 369, 374, 375, 380, 381, 386, 387, 391, 392, 395, 397, 398, 401, 403, 404, 407, 409, 410, 413, 415, 416, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3316, 3317, 3390, 3393, 3471, 3707, 3789, 1045, 1053, 1061, 1069, 1077, 1126, 1134, 1142, 1150, 1158, 1305, 1307, 1309, 1312, 1319, 1330, 1333, 1335, 1337, 1339, 1342, 1349, 1357, 1361, 1365, 1369, 1373, 1375, 1379, 1383, 1387, 1391, 1393, 1578, 1581, 1588, 1591, 1598, 1601, 1608, 1611, 1624, 1627, 1634, 1637, 1644, 1647, 1654, 1657, 1662, 1663, 4289, 4295, 4301, 4307, 4313, 4350, 4356, 4362, 4368, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
16, 441, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 92, 97, 102, 107, 111, 115, 120, 125, 130, 136, 138, 141, 142, 143, 146, 147, 148, 151, 152, 153, 158, 160, 162, 163, 164, 165, 166, 167, 168, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 280, 281, 282, 283, 284, 286, 287, 288, 289, 290, 292, 293, 294, 295, 296, 298, 299, 300, 302, 306, 308, 309, 310, 312, 314, 315, 316, 318, 320, 321, 322, 324, 326, 327, 328, 339, 344, 345, 351, 357, 363, 369, 375, 381, 387, 391, 395, 397, 401, 403, 407, 409, 413, 415, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3316, 3317, 3390, 3393, 3406, 3422, 3438, 3454, 3551, 3567, 3583, 3599, 3615, 3707, 3789, 1045, 1053, 1061, 1069, 1077, 1126, 1134, 1142, 1150, 1158, 1305, 1307, 1309, 1312, 1319, 1330, 1333, 1335, 1337, 1339, 1342, 1349, 1357, 1361, 1365, 1369, 1373, 1375, 1379, 1383, 1387, 1391, 1393, 1581, 1591, 1601, 1611, 1627, 1637, 1647, 1657, 1663, 2028, 2036, 2044, 2052, 2060, 4289, 4295, 4301, 4307, 4313, 4350, 4356, 4362, 4368, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
17, 432, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 70, 71, 74, 75, 76, 79, 80, 81, 84, 85, 86, 92, 97, 102, 107, 111, 115, 120, 125, 130, 136, 138, 141, 142, 143, 146, 147, 148, 151, 152, 153, 158, 160, 162, 163, 164, 165, 166, 167, 168, 169, 170, 171, 172, 173, 174, 175, 176, 177, 181, 183,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 272, 274, 275, 276, 277, 278, 280, 281, 282, 283, 284, 286, 287, 288, 289, 290, 292, 293, 294, 295, 296, 298, 299, 300, 302, 306, 308, 310, 312, 314, 316, 318, 320, 322, 324, 326, 328, 391, 395, 397, 401, 403, 407, 409, 413, 415, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2478, 2496, 2498, 2516, 2518, 2536, 2538, 2556, 2747, 2761, 2767, 2781, 2787, 2801, 2807, 2821, 2827, 2833, 3018, 3036, 3038, 3056, 3058, 3076, 3078, 3096, 3227, 3316, 3317, 3332, 3348, 3364, 3380, 3390, 3406, 3422, 3438, 3454, 3473, 3489, 3505, 3521, 3537, 3551, 3567, 3583, 3599, 3615, 3707, 3789, 1045, 1053, 1061, 1069, 1077, 1126, 1134, 1142, 1150, 1158, 1305, 1307, 1309, 1312, 1319, 1330, 1333, 1335, 1337, 1339, 1342, 1349, 1357, 1361, 1365, 1369, 1373, 1375, 1379, 1383, 1387, 1391, 1393, 1989, 1997, 2005, 2013, 2021, 2028, 2036, 2044, 2052, 2060, 4289, 4295, 4301, 4307, 4313, 4350, 4356, 4362, 4368, 4374, 3826, 3859, 3861, 3862, 3894, 3896, 3897, 3898, 3929, 3931, 3933, 3966, 3968, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
18, 312, [6, 7, 11, 12, 29, 30, 33, 34, 35, 36, 39, 40, 71, 81, 89, 91, 96, 97, 98, 100, 101, 102, 106, 107, 108, 113, 115, 116, 119, 120, 123, 124, 125, 126, 129, 130, 134, 161, 171, 186, 187, 188, 190, 191, 192, 197, 198, 210, 214, 215, 232, 235, 246, 252, 253, 255, 258, 282, 283, 284, 285, 294, 295, 297, 300, 301, 303, 312, 313, 314, 315, 324, 325, 326, 327, 330, 331, 332, 333, 339, 342, 343, 344, 345, 351, 354, 355, 356, 357, 360, 361, 362, 363, 366, 372, 373, 374, 375, 378, 384, 385, 386, 387, 390, 392, 393, 402, 403, 404, 405, 414, 415, 416, 417, 420, 432, 433, 434, 435, 444, 446, 447, 459, 462, 464, 465, 471, 474, 483, 486, 489, 2227, 2240, 2247, 2260, 2267, 2318, 2329, 2369, 2387, 2580, 2587, 2620, 2627, 2678, 2689, 2718, 2729, 2921, 2947, 2980, 2987, 3038, 3049, 3058, 3069, 3089, 3117, 3217, 3233, 3547, 3691, 3723, 498, 527, 582, 587, 607, 611, 631, 642, 651, 655, 662, 787, 791, 811, 822, 831, 835, 842, 896, 902, 962, 966, 973, 989, 1054, 1070, 1133, 1137, 1149, 1153, 1176, 1192, 1205, 1214, 1230, 1248, 1255, 1277, 1302, 1315, 1317, 1318, 1319, 1320, 1322, 1323, 1329, 1332, 1335, 1336, 1337, 1338, 1339, 1340, 1343, 1359, 1361, 1362, 1365, 1367, 1369, 1370, 1379, 1380, 1381, 1383, 1387, 1388, 1389, 1472, 1761, 1879, 1887, 1895, 1927, 1943, 1951, 1967, 1983, 1991, 2007, 2023, 2031, 2039, 2047, 2055, 2063, 2071, 2087, 2103, 2111, 2127, 2143, 2167, 2183, 2191, 2195, 2199, 3853, 3863, 3866, 3902, 3906, 3910, 3922, 3926, 3936, 3944, 3960, 4043, 4046, 4050, 4054, 4066, 4070, 4080, 4088, 4104, 4117, 4146, 4153, 4175, 4202, 4207, 4210, 4218, 4221, 4226, 4231, 4243, 4264, 4276, 4292, 4304, 4377, 4384, 4396, 4421, 4427, 3969, 3970, 4001, 4003, 4005, 4038, 4193, 4196, 4441, 4443]
19, 147, [6, 7, 11, 12, 16, 17, 23, 25, 26, 28, 29, 30, 31, 33, 34, 35, 36, 39, 41, 48, 50, 51, 52, 53, 56, 57, 61, 62, 66, 86, 93, 229, 232, 235, 238, 240, 246, 249, 252, 255, 258, 259, 261, 264, 265, 267, 276, 277, 278, 279, 282, 288, 294, 318, 319, 320, 321, 324, 325, 326, 327, 336, 338, 339, 378, 384, 2220, 2227, 2240, 2247, 2260, 2267, 2280, 2287, 2426, 2437, 2446, 2457, 2466, 2718, 2729, 3156, 495, 585, 652, 675, 742, 762, 1021, 1029, 1037, 1149, 1157, 1307, 1309, 1317, 1357, 1361, 1365, 1369, 1373, 1871, 1879, 1887, 1895, 1903, 1919, 1927, 1935, 1943, 1975, 1983, 1999, 2055, 2063, 3829, 3893, 3895, 3901, 3942, 3952, 3965, 3967, 3973, 3977, 3981, 4024, 4039, 4239, 4245, 4251, 4255, 4261, 4267, 4335, 4341, 4351, 3859, 3861, 4188, 4189, 4192, 4193, 4196, 4197, 4200, 4201, 4204]
20, 144, [6, 7, 11, 12, 16, 17, 23, 25, 26, 28, 29, 30, 31, 33, 34, 35, 36, 39, 41, 51, 52, 55, 56, 57, 58, 61, 62, 66, 81, 103, 120, 229, 232, 235, 238, 240, 246, 249, 252, 253, 255, 258, 261, 264, 267, 276, 282, 283, 284, 285, 288, 289, 290, 291, 294, 312, 313, 314, 315, 342, 344, 345, 348, 350, 372, 2220, 2227, 2240, 2247, 2260, 2267, 2280, 2287, 2397, 2406, 2417, 2446, 2457, 2466, 2678, 2709, 3156, 3211, 3419, 3444, 495, 651, 706, 733, 1013, 1037, 1080, 1141, 1184, 1307, 1309, 1317, 1357, 1361, 1365, 1369, 1373, 1871, 1879, 1887, 1895, 1903, 1919, 1927, 1935, 1943, 1967, 2007, 2015, 2047, 3829, 3893, 3895, 3901, 3942, 3946, 3951, 3978, 3982, 3995, 4023, 4233, 4251, 4255, 4261, 4273, 4329, 4363, 3859, 3861, 4188, 4189, 4192, 4193, 4196, 4197, 4200, 4201, 4204]
21, 144, [12, 36, 58, 79, 80, 81, 84, 85, 93, 95, 96, 97, 98, 100, 102, 103, 120, 124, 125, 129, 131, 138, 176, 187, 235, 252, 253, 255, 282, 283, 284, 285, 288, 289, 290, 291, 312, 313, 314, 315, 321, 336, 337, 339, 342, 344, 345, 348, 350, 372, 378, 379, 380, 381, 384, 385, 386, 387, 396, 397, 398, 399, 438, 440, 444, 446, 447, 456, 2247, 2260, 2519, 2539, 2552, 2678, 2698, 2709, 2937, 2946, 3125, 3130, 3377, 3444, 3684, 3691, 508, 561, 616, 672, 675, 706, 733, 765, 832, 867, 1014, 1141, 1253, 1302, 1365, 1367, 1887, 1927, 1935, 1967, 1999, 2007, 2015, 2047, 2055, 2063, 2079, 2135, 2143, 2159, 3851, 3870, 3874, 3879, 3906, 3910, 3923, 3942, 3946, 3973, 3995, 4037, 4039, 4045, 4049, 4053, 4096, 4109, 4111, 4117, 4234, 4274, 4280, 4329, 4357, 4363, 4412, 4445, 4193, 4196]
22, 388, [8, 12, 28, 30, 32, 33, 34, 35, 36, 37, 41, 48, 50, 51, 52, 53, 54, 55, 56, 57, 58, 59, 60, 62, 64, 68, 70, 72, 73, 74, 75, 76, 77, 78, 79, 80, 81, 82, 83, 84, 85, 86, 87, 89, 91, 93, 94, 95, 96, 97, 98, 99, 100, 101, 102, 103, 104, 105, 106, 107, 108, 109, 112, 113, 115, 117, 118, 119, 120, 121, 122, 123, 124, 125, 126, 127, 128, 129, 130, 131, 132, 136, 138, 140, 141, 142, 143, 144, 145, 146, 147, 148, 149, 150, 151, 152, 153, 154, 157, 162, 163, 164, 165, 166, 167, 168, 169, 170, 171, 172, 174, 176, 186, 188, 190, 191, 192, 193, 194, 199, 214, 216, 233, 236, 251, 252, 253, 255, 256, 257, 258, 259, 261, 263, 276, 277, 279, 281, 282, 283, 284, 285, 286, 287, 288, 289, 290, 291, 292, 293, 299, 305, 306, 307, 308, 309, 310, 311, 312, 313, 314, 315, 316, 317, 318, 319, 320, 321, 322, 323, 324, 325, 327, 329, 330, 331, 333, 335, 336, 337, 338, 339, 340, 341, 342, 343, 344, 345, 346, 347, 348, 349, 350, 351, 352, 353, 354, 355, 356, 357, 358, 359, 360, 362, 364, 365, 366, 367, 368, 369, 370, 371, 372, 373, 374, 375, 376, 377, 378, 379, 380, 381, 382, 383, 384, 385, 386, 387, 388, 389, 390, 394, 396, 397, 398, 399, 400, 401, 402, 403, 404, 405, 406, 407, 408, 409, 410, 411, 412, 413, 414, 416, 418, 419, 426, 428, 430, 431, 432, 433, 434, 435, 436, 437, 438, 439, 440, 441, 442, 443, 444, 448, 456, 460, 462, 464, 466, 467, 468, 470, 472, 473, 486, 488, 489, 491, 2247, 2261, 2764, 2826, 2838, 2916, 2964, 2986, 3038, 3056, 3058, 3076, 3130, 3162, 3208, 3256, 3290, 3306, 3384, 3400, 505, 571, 585, 813, 887, 913, 934, 950, 975, 998, 1006, 1039, 1047, 1165, 1237, 1253, 1322, 1329, 1332, 1337, 1361, 1365, 1367, 1383, 1387, 3836, 3851, 3855, 3865, 3868, 3887, 3901, 3930, 3932, 4082, 4109, 4111, 4116, 4119, 4141, 4162, 4177, 4190, 4212, 4223, 4228, 4254, 4260, 4347, 4375, 4379, 4401, 4412, 4425, 4428, 4435, 4437, 3933, 3934, 3966, 3969, 3970, 4001, 4003, 4005, 4006, 4038, 4040, 4041, 4042, 4075, 4192, 4193, 4195, 4196, 4199, 4438, 4439, 4441, 4443, 4444, 4446]
23, 281, [1, 3, 6, 7, 8, 11, 12, 13, 16, 17, 18, 23, 25, 27, 28, 29, 30, 31, 32, 33, 34, 35, 36, 37, 39, 41, 51, 53, 55, 56, 57, 58, 59, 60, 61, 62, 63, 64, 67, 68, 70, 72, 73, 74, 75, 76, 77, 79, 81, 101, 103, 105, 106, 107, 108, 109, 112, 113, 115, 117, 119, 121, 151, 153, 157, 230, 233, 236, 239, 240, 241, 243, 244, 245, 246, 247, 249, 250, 251, 252, 253, 255, 256, 257, 258, 259, 261, 262, 263, 264, 268, 276, 280, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 322, 342, 346, 348, 349, 350, 351, 352, 353, 354, 355, 356, 357, 358, 359, 360, 361, 362, 363, 364, 365, 366, 367, 368, 369, 370, 371, 372, 376, 408, 412, 414, 415, 416, 417, 418, 419, 420, 421, 422, 423, 424, 425, 426, 430, 474, 478, 480, 2207, 2227, 2241, 2247, 2261, 2267, 2281, 2287, 2293, 2376, 2424, 2536, 2624, 2696, 2824, 2856, 3016, 3789, 904, 908, 945, 947, 997, 1013, 1069, 1101, 1141, 1189, 1213, 1277, 1305, 1307, 1309, 1319, 1329, 1339, 1347, 1348, 1349, 1350, 1355, 1356, 1357, 1358, 1361, 1365, 1369, 1373, 1375, 1403, 3893, 3895, 3900, 3903, 3957, 3961, 3978, 3982, 4021, 4025, 4058, 4062, 4085, 4089, 4138, 4142, 4222, 4233, 4275, 4299, 4329, 4365, 4383, 4427, 3826, 3859, 3861, 3862, 3929, 3931, 3933, 3934, 4001, 4003, 4005, 4006, 4073, 4075, 4077, 4078, 4189, 4191, 4192, 4193, 4195, 4196, 4197, 4199, 4200, 4201, 4203, 4204, 4431]
24, 189, [91, 95, 98, 99, 100, 101, 102, 103, 104, 109, 118, 119, 122, 123, 125, 126, 127, 129, 131, 132, 136, 140, 143, 144, 145, 146, 147, 148, 149, 154, 283, 311, 313, 317, 319, 323, 329, 336, 337, 340, 341, 342, 343, 345, 346, 347, 348, 349, 352, 353, 366, 367, 370, 371, 372, 373, 374, 375, 376, 377, 378, 379, 380, 381, 382, 383, 384, 385, 388, 389, 396, 397, 400, 401, 402, 403, 404, 406, 407, 408, 409, 412, 413,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

426, 432, 436, 438, 442, 444, 466, 2499, 2504, 2510, 2513, 2519, 2524, 2530, 2533, 2539, 2544, 2550, 2553, 2858, 2861, 2871, 2876, 2878, 2881, 2891, 2896, 2898, 2901, 2911, 2916, 3241, 3274, 3322, 3346, 3351, 3362, 3368, 3369, 3424, 3587, 3653, 3660, 3661, 3675, 3677, 3702, 3734, 3765, 640, 674, 675, 711, 722, 764, 765, 801, 812, 852, 982, 990, 1027, 1059, 1083, 1213, 1237, 1261, 1296, 1300, 1496, 1497, 1502, 1506, 1507, 1513, 1767, 1772, 1773, 1776, 1782, 1783, 1958, 1982, 1995, 1998, 2011, 2014, 2035, 2038, 2059, 2062, 2075, 2078, 2091, 2094, 2115, 2139, 3976, 3980, 3993, 4012, 4016, 4037, 4048, 4052, 4065]
25, 256, [1, 3, 6, 7, 8, 11, 12, 13, 16, 17, 18, 25, 27, 29, 30, 31, 32, 34, 35, 36, 37, 39, 40, 41, 42, 48, 49, 52, 53, 54, 57, 58, 59, 62, 63, 64, 67, 70, 72, 75, 76, 77, 80, 81, 82, 85, 86, 87, 93, 94, 98, 99, 103, 104, 108, 109, 112, 117, 121, 122, 126, 127, 131, 132, 227, 230, 233, 236, 239, 243, 244, 245, 249, 250, 251, 255, 256, 257, 261, 262, 263, 267, 268, 269, 273, 274, 275, 278, 279, 280, 281, 284, 285, 286, 287, 290, 291, 292, 293, 296, 297, 298, 299, 302, 303, 304, 305, 308, 309, 310, 311, 314, 315, 316, 317, 320, 321, 322, 323, 326, 327, 328, 329, 334, 335, 339, 340, 341, 345, 346, 347, 351, 352, 353, 357, 358, 359, 364, 365, 370, 371, 376, 377, 382, 383, 388, 389, 400, 406, 412, 418, 2221, 2241, 2261, 2281, 2293, 2391, 2411, 2431, 2451, 2574, 2594, 2614, 2634, 2650, 2759, 2764, 2779, 2784, 2799, 2804, 2819, 2824, 2836, 3107, 3163, 3179, 3195, 3211, 3230, 3390, 3395, 3406, 3422, 3438, 3454, 3491, 3507, 3523, 3539, 3558, 1212, 1220, 1228, 1236, 1244, 1305, 1307, 1317, 1320, 1323, 1326, 1328, 1338, 1355, 1357, 1361, 1365, 1369, 1373, 1396, 1406, 1416, 1426, 1436, 1442, 1452, 1462, 1472, 1534, 1544, 1554, 1564, 1572, 1626, 1636, 1646, 1656, 1866, 2030, 3826, 3859, 3861, 3862, 3894, 3896, 3898, 3931, 3934, 3968, 4006, 4040, 4187, 4188, 4189, 4191, 4192, 4193, 4195, 4196, 4197, 4199, 4200, 4201, 4203, 4204]
26, 319, [18, 23, 27, 28, 29, 33, 34, 38, 39, 42, 48, 50, 51, 55, 56, 60, 68, 69, 73, 74, 78, 79, 83, 84, 88, 91, 95, 96, 100, 101, 105, 106, 113, 114, 118, 119, 123, 124, 128, 129, 133, 136, 140, 141, 145, 146, 150, 151, 158, 163, 164, 168, 169, 173, 174, 179, 184, 185, 186, 190, 191, 195, 202, 206, 219, 227, 230, 231, 234, 239, 240, 241, 244, 245, 246, 247, 251, 252, 253, 258, 259, 264, 265, 268, 269, 270, 271, 274, 276, 277, 282, 283, 288, 289, 294, 295, 298, 300, 301, 306, 307, 312, 313, 318, 319, 324, 325, 330, 331, 336, 337, 342, 343, 348, 349, 354, 355, 360, 361, 366, 367, 372, 373, 378, 379, 384, 385, 390, 391, 396, 397, 402, 403, 408, 409, 414, 415, 420, 421, 425, 426, 427, 431, 432, 433, 438, 439, 444, 445, 449, 450, 455, 456, 460, 461, 462, 463, 468, 469, 474, 478, 479, 480, 483, 485, 486, 489, 492, 494, 2207, 2221, 2227, 2232, 2247, 2252, 2267, 2287, 2293, 2404, 2476, 2853, 2913, 3018, 3036, 3038, 3041, 3058, 3061, 3078, 3096, 3176, 3253, 3309, 3325, 3373, 3632, 3648, 3696, 3707, 3720, 3789, 1305, 1307, 1309, 1312, 1319, 1322, 1329, 1332, 1339, 1342, 1349, 1357, 1361, 1365, 1369, 1373, 1375, 1379, 1383, 1387, 1391, 1393, 1883, 1891, 1923, 1931, 1963, 1971, 1987, 1995, 2003, 2011, 2019, 2027, 2035, 2043, 2051, 2059, 2067, 2075, 2083, 2091, 2099, 2123, 2131, 2163, 2171, 2193, 2197, 3835, 3839, 3852, 3873, 3890, 3907, 3924, 3928, 4089, 4106, 4123, 4127, 4140, 4144, 4161, 4178, 4227, 4233, 4251, 4259, 4265, 4283, 4348, 4354, 4372, 4380, 4386, 4404, 3826, 3859, 3861, 3862, 3894, 3896, 3897, 3898, 3929, 3931, 3969, 4001, 4041, 4073, 4077, 4078, 4110, 4113, 4114, 4145, 4147, 4149, 4182, 4184, 4185, 4187, 4188, 4189, 4191, 4200, 4201, 4203, 4204, 4431, 4433, 4434, 4436, 4448, 4449, 4451, 4454]
27, 161, [8, 12, 30, 31, 32, 34, 35, 36, 37, 41, 48, 49, 51, 52, 53, 54, 55, 56, 57, 58, 59, 62, 63, 64, 67, 75, 76, 77, 79, 80, 81, 82, 86, 102, 103, 104, 149, 233, 236, 245, 251, 253, 255, 256, 257, 261, 263, 269, 275, 280, 281, 282, 283, 284, 285, 286, 287, 290, 291, 292, 293, 298, 299, 310, 312, 314, 315, 316, 317, 320, 322, 323, 328, 344, 346, 347, 376, 377, 406, 407, 2230, 2261, 2313, 2339, 2367, 2373, 2382, 2486, 2491, 2496, 2498, 2556, 2611, 2891, 3130, 3195, 3208, 3219, 3240, 3274, 3298, 3317, 3355, 3427, 3445, 3506, 3587, 3669, 509, 553, 574, 643, 664, 710, 749, 782, 791, 839, 952, 964, 971, 1003, 1057, 1081, 1092, 1101, 1124, 1152, 1268, 1316, 1318, 1365, 1367, 1416, 1446, 1452, 1552, 1566, 1596, 1690, 1870, 1910, 1916, 1956, 3851, 3855, 3980, 3984, 4020, 4212, 4295, 4305, 4327, 4337, 3862, 3968, 4192, 4193, 4195, 4196, 4199]
28, 244, [2, 3, 6, 7, 8, 11, 12, 13, 16, 17, 25, 26, 28, 29, 30, 31, 32, 33, 34, 35, 36, 37, 39, 40, 41, 44, 46, 51, 52, 53, 56, 57, 58, 62, 63, 66, 75, 79, 80, 81, 96, 97, 98, 101, 102, 103, 107, 120, 124, 125, 126, 141, 142, 143, 146, 147, 148, 152, 165, 169, 170, 171, 192, 230, 233, 236, 238, 246, 247, 250, 251, 252, 253, 255, 256, 257, 258, 259, 261, 262, 263, 267, 276, 278, 279, 280, 282, 284, 285, 286, 288, 290, 291, 292, 308, 314, 315, 320, 321, 344, 345, 350, 351, 374, 375, 380, 381, 404, 405, 410, 411, 434, 435, 440, 441, 464, 465, 470, 2210, 2227, 2241, 2247, 2261, 2267, 2280, 2281, 2298, 2313, 2359, 2376, 2397, 2406, 2424, 2446, 2447, 2464, 2503, 2512, 2542, 2549, 2683, 2692, 2722, 2729, 2863, 2872, 2902, 2909, 2951, 2956, 2957, 2971, 2977, 2994, 3046, 3068, 3109, 3138, 3151, 3156, 3211, 3224, 3230, 3259, 3275, 3301, 3332, 3349, 3365, 3406, 3409, 3487, 3492, 3566, 3569, 3647, 3652, 3726, 3764, 3810, 636, 665, 726, 755, 816, 845, 1009, 1013, 1048, 1080, 1305, 1317, 1355, 1361, 1365, 1369, 1371, 1374, 1385, 1824, 1827, 1846, 1866, 1871, 1911, 1962, 1970, 2002, 2007, 2010, 2015, 2042, 2047, 2050, 2055, 2082, 2087, 2090, 2095, 2122, 2127, 2130, 2135, 2167, 2175, 4251, 4265, 3859, 3861, 3894, 3898, 4188, 4189, 4191, 4192, 4193, 4195, 4196, 4197, 4199, 4200, 4441]
29, 294, [1, 6, 11, 16, 23, 24, 28, 29, 33, 34, 36, 38, 39, 43, 46, 50, 51, 53, 54, 55, 56, 57, 58, 59, 60, 61, 68, 69, 73, 74, 75, 77, 78, 79, 80, 81, 82, 83, 84, 88, 91, 95, 96, 98, 99, 100, 101, 102, 103, 104, 105, 106, 109, 113, 114, 118, 119, 120, 121, 122, 123, 124, 125, 126, 127, 128, 129, 140, 141, 145, 146, 147, 148, 150, 151, 163, 164, 168, 169, 190, 191, 240, 241, 246, 247, 248, 252, 253, 254, 257, 258, 259, 260, 263, 264, 265, 266, 270, 271, 276, 277, 278, 281, 282, 283, 285, 286, 287, 288, 289, 291, 292, 293, 294, 295, 296, 300, 301, 306, 307, 309, 310, 311, 312, 313, 314, 315, 316, 317, 318, 319, 320, 321, 322, 323, 324, 325, 326, 330, 336, 337, 338, 340, 341, 342, 343, 344, 345, 346, 347, 348, 349, 350, 351, 352, 353, 354, 355, 356, 360, 366, 367, 372, 373, 374, 376, 377, 378, 379, 380, 382, 383, 384, 386, 396, 398, 402, 403, 406, 408, 409, 414, 426, 432, 433, 434, 438, 440, 462, 464, 468, 486, 2207, 2227, 2241, 2247, 2261, 2267, 2287, 2333, 2353, 2461, 2485, 2548, 2665, 2728, 2737, 2749, 2776, 2804, 2813, 2901, 2949, 3061, 3149, 3232, 3309, 3387, 3392, 3469, 3493, 3531, 3563, 3605, 3613, 3645, 3675, 3739, 3757, 3801, 806, 812, 886, 912, 1125, 1197, 1213, 1269, 1305, 1307, 1309, 1312, 1319, 1322, 1329, 1357, 1361, 1365, 1369, 1373, 1383, 1399, 1409, 1419, 1429, 1437, 1445, 1475, 1489, 1527, 1579, 1617, 1725, 1735, 1779, 3874, 3889, 3903, 3925, 3940, 3963, 3975, 3997, 4035, 4056, 4194, 4198, 4211, 4216, 4220, 4236, 4323, 4355, 4359, 4365, 4391, 4397, 3897, 3929, 3969, 4001, 4185, 4189, 4193, 4197, 4201]
30, 389, [3, 8, 13, 18, 25, 29, 30, 31, 32, 35, 36, 39, 40, 41, 42, 46, 49, 52, 57, 59, 61, 62, 67, 70, 74, 75, 80, 84, 85, 93, 94, 97, 98, 102, 103, 104, 107, 108, 112, 115, 120, 121, 122, 125, 126, 130, 131, 132, 136, 139, 142, 147, 149, 151, 152, 157, 160, 164, 165, 170, 174, 175, 181, 183, 184, 187, 188, 192, 193, 194, 196, 197, 198, 202, 206, 211, 216, 221, 227, 230, 233, 236, 239, 243, 244, 245, 247, 249, 250, 255, 256, 257, 261, 262, 265, 267, 268, 269, 273, 274, 275, 276, 277, 278, 279, 285, 286, 287, 288, 290, 291, 294, 295, 296, 297, 298, 299, 303, 304, 305, 306, 308, 309, 315, 316, 317, 318, 320, 321, 324, 326, 327, 328, 329, 333, 334, 335, 341, 345, 346, 347, 353, 357, 358, 359, 363, 364, 365, 369, 370, 375, 376, 377, 381, 382, 387, 388, 389, 393, 394, 395, 397, 399, 405, 406, 407, 409, 411, 417, 418, 419, 423, 424, 425, 426, 427, 428, 429, 435, 436, 437, 438, 439, 440, 441, 444, 446, 447, 448, 449, 454, 455, 456, 458, 461, 466, 467, 468, 470, 473, 474, 476, 478, 479, 485, 488, 491, 494, 2215, 2221, 2235, 2241, 2255, 2261, 2275, 2281, 2291, 2293, 2299, 2316, 2356, 2359, 2400, 2417, 2440, 2457, 2478, 2538, 2601, 2641, 2676, 2716, 2760, 2767, 2777, 2800, 2807, 2817, 2946, 2961, 2986, 3001, 3026, 3036, 3046, 3056, 3066, 3076, 3086, 3096, 3167, 3194, 3199, 3215, 3275, 3406, 3438, 3454, 3567, 3599, 3610, 3615, 3691, 3715, 3789, 3794, 3810, 3818, 543, 551, 582, 585, 626, 633, 652, 659, 672, 765, 777, 788, 821, 832, 839, 867, 878, 896, 950, 958, 962, 1053, 1069, 1077, 1134, 1150, 1158, 1180, 1196, 1253, 1269, 1277, 1306, 1308, 1310, 1313, 1320, 1321, 1323, 1324, 1330, 1333, 1340, 1341, 1343, 1344, 1350, 1358, 1360, 1362, 1366, 1368, 1370, 1374, 1376, 1380, 1382, 1384, 1388, 1390, 1392, 1394, 1547, 1567, 1727, 1747, 1868, 1884, 1908, 1924, 1948, 1964, 1988, 2004, 2028, 2036, 2044, 2052, 2060, 2068, 2084, 2108, 2124, 2148, 2164, 2186, 2194, 3905, 3914, 3939, 3948, 3964, 4079, 4083, 4092, 4108, 4109, 4235, 4247, 4296, 4308, 4414, 4424, 3862, 3896, 3898, 3931, 3970, 4003, 4006, 4040, 4042, 4075, 4114, 4147, 4184, 4187, 4195, 4203, 4434, 4444]

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

31, 349, [1, 3, 6, 7, 8, 11, 12, 13, 16, 17, 18, 23, 25, 26, 28, 29, 30, 31, 33, 34, 35, 36, 38, 39, 40, 41, 44, 46, 48, 50, 51, 52, 53, 54, 55, 56, 57, 58, 60, 61, 62, 63, 64, 70, 71, 74, 75, 76, 79, 80, 81, 84, 85, 86, 89, 93, 98, 103, 108, 115, 116, 121, 126, 130, 131, 134, 138, 143, 148, 153, 160, 161, 162, 166, 171, 175, 176, 177, 179, 183, 188, 193, 198, 206, 211, 243, 246, 247, 249, 250, 251, 252, 253, 255, 256, 258, 259, 261, 262, 263, 264, 265, 267, 268, 269, 272, 273, 276, 277, 278, 279, 280, 281, 282, 284, 285, 286, 288, 290, 291, 292, 293, 294, 295, 296, 297, 298, 299, 302, 303, 306, 308, 309, 310, 312, 314, 316, 318, 320, 322, 324, 326, 327, 328, 333, 339, 340, 346, 352, 357, 358, 363, 369, 370, 376, 382, 387, 388, 393, 399, 400, 401, 406, 412, 413, 417, 418, 419, 423, 429, 430, 431, 436, 442, 443, 447, 448, 449, 460, 466, 472, 478, 485, 488, 491, 494, 2207, 2227, 2247, 2267, 2313, 2353, 2373, 2387, 2404, 2466, 2473, 2478, 2483, 2496, 2498, 2516, 2518, 2538, 2556, 2781, 2821, 2833, 2876, 2893, 2944, 2964, 3004, 3026, 3071, 3086, 3091, 3101, 3107, 3146, 3157, 3227, 3240, 3317, 3347, 3363, 3390, 3400, 3406, 3454, 3477, 3560, 3637, 3715, 3720, 3789, 690, 709, 780, 799, 870, 889, 1053, 1061, 1069, 1077, 1305, 1307, 1315, 1317, 1320, 1330, 1333, 1340, 1343, 1350, 1355, 1357, 1361, 1365, 1369, 1373, 1376, 1380, 1382, 1386, 1392, 1403, 1413, 1423, 1433, 1436, 1439, 1459, 1513, 1559, 1583, 1593, 1603, 1613, 1619, 1629, 1639, 1649, 1659, 1673, 1693, 1783, 1799, 1809, 1819, 1829, 1839, 2006, 2014, 2028, 2036, 2046, 2054, 2060, 2068, 2076, 2086, 2094, 2100, 2108, 2116, 2126, 2134, 2140, 2148, 2156, 2166, 2174, 2180, 2186, 2190, 2202, 4297, 4303, 3826, 3859, 3861, 3894, 3898, 3931, 3966, 3970, 4003, 4042, 4075, 4114, 4147, 4187, 4188, 4189, 4191, 4192, 4193, 4195, 4196, 4197, 4199, 4200, 4201, 4203, 4204, 4434, 4449]
32, 487, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 72, 73, 77, 78, 82, 83, 85, 87, 93, 94, 95, 99, 100, 104, 105, 108, 109, 112, 113, 115, 117, 118, 122, 123, 127, 128, 130, 132, 138, 139, 140, 144, 145, 149, 150, 153, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 255, 256, 257, 258, 261, 262, 263, 264, 265, 267, 268, 269, 270, 271, 272, 273, 274, 275, 276, 277, 278, 279, 280, 281, 282, 283, 286, 287, 288, 289, 292, 293, 294, 295, 296, 297, 298, 299, 300, 301, 302, 303, 304, 305, 306, 307, 308, 309, 310, 311, 312, 313, 316, 317, 318, 319, 322, 323, 324, 325, 326, 327, 328, 329, 330, 331, 332, 333, 334, 335, 336, 337, 338, 339, 340, 341, 342, 343, 346, 347, 348, 349, 352, 353, 354, 355, 356, 357, 358, 359, 360, 361, 362, 363, 364, 365, 366, 367, 368, 369, 370, 371, 372, 373, 376, 377, 378, 379, 382, 383, 384, 385, 386, 387, 388, 389, 390, 391, 392, 393, 394, 395, 396, 397, 398, 399, 400, 401, 402, 403, 406, 407, 408, 409, 412, 413, 414, 415, 416, 417, 418, 419, 420, 421, 422, 423, 424, 425, 426, 427, 428, 429, 430, 431, 432, 435, 436, 437, 438, 441, 442, 443, 444, 445, 446, 447, 448, 449, 450, 452, 454, 455, 456, 458, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2501, 2510, 2544, 2551, 2681, 2690, 2724, 2731, 3018, 3036, 3038, 3056, 3058, 3076, 3078, 3096, 3707, 3789, 1305, 1307, 1309, 1312, 1319, 1322, 1329, 1332, 1339, 1342, 1349, 1357, 1361, 1365, 1369, 1373, 1375, 1379, 1383, 1387, 1391, 1393, 1553, 1558, 1587, 1592, 1597, 1602, 1643, 1648, 1677, 1682, 1687, 1692, 3979, 3996, 4051, 4068, 4239, 4245, 4267, 4273, 4360, 4366, 4388, 4394, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
33, 489, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 56, 58, 59, 60, 61, 62, 63, 64, 67, 68, 70, 72, 73, 74, 75, 76, 77, 78, 81, 82, 83, 87, 94, 95, 99, 101, 103, 104, 105, 106, 107, 108, 109, 112, 113, 115, 117, 118, 119, 120, 121, 123, 126, 127, 128, 132, 139, 140, 144, 148, 149, 150, 151, 152, 153, 154, 157, 158, 160, 162, 163, 164, 165, 166, 167, 168, 171, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 262, 263, 264, 265, 267, 268, 269, 270, 271, 272, 273, 274, 275, 276, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 323, 324, 325, 326, 327, 328, 329, 330, 331, 332, 333, 334, 335, 336, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 383, 384, 385, 386, 387, 388, 389, 390, 391, 392, 393, 394, 395, 396, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 443, 444, 445, 446, 447, 448, 449, 450, 452, 454, 455, 456, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3196, 3254, 3673, 3707, 3735, 3789, 1305, 1307, 1309, 1312, 1315, 1316, 1319, 1322, 1323, 1325, 1326, 1329, 1332, 1333, 1335, 1336, 1339, 1342, 1343, 1349, 1357, 1359, 1361, 1362, 1365, 1369, 1373, 1375, 1379, 1383, 1387, 1388, 1389, 1391, 1393, 1913, 1969, 1976, 1993, 2000, 2049, 2056, 2073, 2080, 2136, 3899, 3902, 3906, 3910, 3951, 3960, 3971, 3974, 3978, 3982, 4023, 4032, 4043, 4046, 4050, 4054, 4095, 4104, 4218, 4231, 4396, 4411, 3826, 3859, 3861, 3862, 3894, 3896, 3929, 3931, 3933, 3934, 3968, 4001, 4003, 4005, 4006, 4040, 4073, 4075, 4077, 4078, 4112, 4113, 4114, 4145, 4147, 4149, 4182, 4184, 4185, 4187, 4188, 4191, 4193, 4195, 4196, 4197, 4199, 4200, 4201, 4203, 4204, 4431, 4433, 4434, 4436, 4438, 4439, 4441, 4443, 4444, 4449, 4451, 4454]
34, 475, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 58, 59, 60, 61, 62, 63, 64, 67, 68, 70, 72, 74, 76, 77, 78, 82, 83, 87, 94, 95, 99, 100, 103, 104, 105, 106, 107, 108, 109, 112, 113, 115, 117, 119, 121, 122, 123, 127, 128, 132, 139, 140, 144, 145, 148, 149, 150, 151, 152, 153, 154, 157, 158, 160, 162, 164, 166, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 262, 263, 264, 265, 267, 268, 269, 270, 271, 272, 273, 274, 275, 276, 281, 282, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 323, 324, 325, 326, 327, 328, 329, 330, 331, 332, 333, 334, 335, 336, 341, 342, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 383, 384, 385, 386, 387, 388, 389, 390, 391, 392, 393, 394, 395, 396, 401, 402, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 443, 444, 445, 446, 447, 448, 449, 450, 452, 454, 455, 456, 461, 462, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3196, 3254, 3270, 3673, 3707, 3735, 3751, 3789, 1305, 1307, 1309, 1312, 1315, 1316, 1319, 1322, 1323, 1325, 1326, 1329, 1332, 1333, 1335, 1336, 1339, 1342, 1343, 1349, 1357, 1359, 1361, 1362, 1363, 1365, 1369, 1373, 1375, 1379, 1383, 1385, 1387, 1388, 1389, 1391, 1393, 1913, 1921, 1969, 1976, 1993, 2000, 2001, 2008, 2049, 2056, 2073, 2080, 2081, 2088, 2136, 3899, 3902, 3916, 3949, 3953, 3960, 3971, 3974, 3988, 4021, 4025, 4032, 4043, 4046, 4060, 4093, 4097, 4104, 4218, 4231, 4237, 4396, 4411, 4416, 3826, 3859, 3861, 3862, 3894, 3896, 3929, 3931, 3933, 3934, 3968, 4001, 4003, 4005, 4006, 4040, 4073, 4075, 4077, 4078, 4112, 4113, 4114, 4145, 4147, 4149, 4182, 4184, 4185, 4187, 4188, 4191, 4195, 4196, 4197, 4199, 4200, 4201, 4203, 4204, 4431, 4433, 4434, 4436, 4438, 4439, 4441, 4444, 4449, 4451, 4454]
35, 461, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 61, 63, 64, 67, 68, 70, 72, 73, 76, 77, 78, 82, 83, 87, 94, 95, 99, 100, 104, 106, 108, 109, 112, 113, 115, 117, 118, 121, 122, 123, 127, 128, 132, 139, 140, 144, 145, 149, 151, 153, 154, 157, 158, 160, 162, 163, 166, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

244, 245, 246, 247, 249, 250, 251, 252, 256, 257, 258, 262, 263, 264, 265, 267, 268, 269, 270, 271, 272, 273, 274, 275, 276, 281, 282, 287, 288, 289, 290, 291, 292, 293, 294, 295, 296, 297, 298, 299, 300, 301, 302, 303, 304, 305, 306, 307, 308, 309, 310, 311, 312, 317, 318, 323, 324, 325, 326, 327, 328, 329, 330, 331, 332, 333, 334, 335, 336, 341, 342, 347, 348, 349, 350, 351, 352, 353, 354, 355, 356, 357, 358, 359, 360, 361, 362, 363, 364, 365, 366, 367, 368, 369, 370, 371, 372, 377, 378, 383, 384, 385, 386, 387, 388, 389, 390, 391, 392, 393, 394, 395, 396, 401, 402, 407, 408, 409, 410, 411, 412, 413, 414, 415, 416, 417, 418, 419, 420, 421, 422, 423, 424, 425, 426, 427, 428, 429, 430, 431, 432, 437, 438, 443, 444, 445, 446, 447, 448, 449, 450, 452, 454, 455, 456, 461, 462, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3180, 3196, 3254, 3270, 3657, 3673, 3707, 3735, 3751, 3789, 1305, 1307, 1309, 1312, 1315, 1316, 1319, 1322, 1323, 1325, 1326, 1329, 1332, 1333, 1335, 1336, 1339, 1342, 1343, 1349, 1357, 1359, 1361, 1362, 1363, 1365, 1366, 1369, 1373, 1375, 1379, 1383, 1384, 1385, 1387, 1388, 1389, 1391, 1393, 1913, 1921, 1961, 1968, 1969, 1976, 1993, 2000, 2001, 2008, 2041, 2048, 2049, 2056, 2073, 2080, 2081, 2088, 2128, 2136, 3899, 3902, 3914, 3918, 3943, 3960, 3971, 3974, 3986, 3990, 4015, 4032, 4043, 4046, 4058, 4062, 4087, 4104, 4214, 4218, 4231, 4237, 4390, 4396, 4411, 4416, 3826, 3859, 3861, 3862, 3894, 3896, 3929, 3931, 3933, 3934, 3968, 4001, 4003, 4005, 4006, 4040, 4073, 4075, 4077, 4078, 4112, 4113, 4114, 4145, 4147, 4149, 4182, 4184, 4185, 4187, 4188, 4191, 4195, 4197, 4199, 4200, 4201, 4203, 4204, 4431, 4433, 4434, 4436, 4438, 4439, 4444, 4449, 4451, 4454]
36, 457, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 72, 73, 77, 78, 82, 83, 87, 94, 95, 99, 100, 104, 105, 109, 112, 113, 117, 118, 122, 123, 127, 128, 132, 139, 140, 144, 145, 149, 150, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 249, 250, 251, 252, 255, 256, 257, 258, 261, 262, 263, 264, 265, 267, 268, 269, 270, 271, 272, 273, 274, 275, 276, 280, 281, 282, 286, 287, 288, 292, 293, 294, 295, 296, 297, 298, 299, 300, 301, 302, 303, 304, 305, 306, 311, 312, 317, 318, 323, 324, 325, 326, 327, 328, 329, 330, 331, 332, 333, 334, 335, 336, 341, 342, 347, 348, 353, 354, 355, 356, 357, 358, 359, 360, 361, 362, 363, 364, 365, 366, 371, 372, 377, 378, 383, 384, 385, 386, 387, 388, 389, 390, 391, 392, 393, 394, 395, 396, 401, 402, 407, 408, 413, 414, 415, 416, 417, 418, 419, 420, 421, 422, 423, 424, 425, 426, 429, 431, 432, 435, 437, 438, 441, 443, 444, 445, 446, 447, 448, 449, 450, 452, 454, 455, 456, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3244, 3260, 3276, 3334, 3350, 3366, 3561, 3577, 3593, 3655, 3671, 3687, 3707, 3789, 1305, 1307, 1309, 1312, 1319, 1320, 1322, 1323, 1325, 1326, 1327, 1328, 1329, 1330, 1332, 1333, 1335, 1336, 1337, 1338, 1339, 1342, 1349, 1357, 1361, 1365, 1369, 1373, 1375, 1379, 1383, 1387, 1391, 1393, 1953, 1961, 1969, 1993, 2000, 2001, 2008, 2009, 2016, 2033, 2040, 2041, 2048, 2049, 2056, 2080, 2088, 2096, 3936, 3960, 3971, 3974, 3994, 3998, 4008, 4032, 4043, 4046, 4066, 4070, 4233, 4239, 4245, 4261, 4267, 4273, 4354, 4360, 4366, 4382, 4388, 4394, 3826, 3859, 3861, 3862, 3894, 3896, 3897, 3898, 3929, 3931, 3934, 3968, 4006, 4040, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
37, 447, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 60, 63, 64, 67, 72, 73, 77, 78, 82, 83, 87, 94, 95, 99, 100, 104, 105, 108, 109, 112, 117, 118, 122, 123, 127, 128, 132, 139, 140, 144, 145, 149, 150, 153, 154, 157, 162, 163, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 256, 257, 258, 262, 263, 264, 265, 267, 268, 269, 270, 271, 272, 273, 274, 275, 276, 281, 282, 287, 288, 293, 294, 295, 296, 297, 298, 299, 300, 301, 302, 303, 304, 305, 306, 307, 308, 309, 310, 311, 312, 317, 318, 323, 324, 325, 326, 327, 328, 329, 330, 331, 332, 333, 334, 335, 336, 341, 342, 347, 348, 353, 354, 355, 356, 357, 358, 359, 360, 361, 362, 363, 364, 365, 366, 367, 368, 369, 370, 371, 372, 377, 378, 383, 384, 385, 386, 387, 388, 389, 390, 391, 392, 393, 394, 395, 396, 401, 402, 407, 408, 413, 414, 415, 416, 417, 418, 419, 420, 421, 422, 423, 424, 425, 426, 427, 428, 429, 430, 431, 432, 437, 438, 443, 444, 445, 446, 447, 448, 449, 450, 452, 454, 455, 456, 461, 462, 467, 468, 473, 474, 476, 478, 479, 480, 483, 485, 486, 488, 489, 491, 492, 494, 2207, 2221, 2227, 2241, 2247, 2261, 2267, 2281, 2287, 2293, 3018, 3036, 3038, 3056, 3058, 3076, 3078, 3096, 3180, 3196, 3254, 3270, 3286, 3657, 3673, 3707, 3735, 3751, 3767, 3789, 1305, 1307, 1309, 1312, 1315, 1316, 1319, 1322, 1323, 1325, 1326, 1329, 1332, 1333, 1335, 1336, 1339, 1342, 1343, 1349, 1357, 1359, 1361, 1362, 1363, 1365, 1366, 1367, 1369, 1373, 1375, 1379, 1381, 1383, 1384, 1385, 1387, 1388, 1389, 1391, 1393, 1913, 1921, 1929, 1961, 1968, 1969, 1976, 1993, 2000, 2001, 2008, 2009, 2016, 2041, 2048, 2049, 2056, 2073, 2080, 2081, 2088, 2089, 2096, 2128, 2136, 3899, 3902, 3924, 3941, 3945, 3960, 3971, 3974, 3996, 4013, 4017, 4032, 4043, 4046, 4068, 4085, 4089, 4104, 4214, 4218, 4231, 4237, 4243, 4390, 4396, 4411, 4416, 4421, 3826, 3859, 3861, 3862, 3894, 3896, 3929, 3931, 3933, 3934, 3968, 4001, 4003, 4005, 4006, 4040, 4073, 4075, 4077, 4078, 4112, 4113, 4114, 4145, 4147, 4149, 4182, 4184, 4185, 4187, 4188, 4191, 4195, 4199, 4200, 4201, 4203, 4204, 4431, 4433, 4434, 4436, 4439, 4444, 4449, 4451, 4454]
38, 490, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 60, 64, 67, 68, 72, 73, 75, 77, 78, 79, 80, 81, 82, 83, 87, 94, 95, 98, 99, 100, 102, 103, 104, 105, 109, 112, 113, 117, 118, 120, 122, 123, 124, 125, 126, 127, 128, 132, 139, 140, 143, 144, 145, 147, 148, 149, 150, 154, 157, 158, 162, 163, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 250, 251, 252, 253, 256, 257, 258, 259, 262, 263, 264, 265, 267, 268, 269, 270, 271, 272, 273, 274, 275, 276, 277, 280, 281, 282, 283, 286, 287, 288, 289, 292, 293, 294, 295, 296, 297, 298, 299, 300, 301, 302, 303, 304, 305, 306, 307, 310, 311, 312, 315, 316, 317, 318, 321, 322, 323, 324, 325, 326, 327, 328, 329, 330, 331, 332, 333, 334, 335, 336, 337, 340, 341, 342, 343, 345, 346, 347, 348, 349, 351, 352, 353, 354, 355, 356, 357, 358, 359, 360, 361, 362, 363, 364, 365, 366, 367, 370, 371, 372, 374, 375, 376, 377, 378, 380, 381, 382, 383, 384, 385, 386, 387, 388, 389, 390, 391, 392, 393, 394, 395, 396, 397, 400, 401, 402, 403, 406, 407, 408, 409, 412, 413, 414, 415, 416, 417, 418, 419, 420, 421, 422, 423, 424, 425, 426, 427, 430, 431, 432, 433, 436, 437, 438, 439, 442, 443, 444, 445, 446, 447, 448, 449, 450, 452, 454, 455, 456, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2392, 2399, 2449, 2458, 2504, 2511, 2541, 2550, 2572, 2579, 2629, 2638, 2684, 2691, 2721, 2730, 2752, 2759, 2809, 2818, 3018, 3036, 3038, 3056, 3058, 3076, 3078, 3096, 3707, 3789, 1305, 1307, 1309, 1312, 1319, 1320, 1322, 1323, 1329, 1330, 1332, 1333, 1339, 1340, 1342, 1343, 1349, 1357, 1359, 1361, 1362, 1363, 1365, 1366, 1367, 1369, 1370, 1373, 1375, 1379, 1380, 1381, 1383, 1384, 1385, 1387, 1388, 1389, 1391, 1393, 1497, 1502, 1507, 1512, 1723, 1728, 1733, 1738, 1743, 1748, 3936, 3960, 3980, 3995, 4008, 4032, 4052, 4067, 4080, 4104, 4210, 4214, 4218, 4231, 4237, 4240, 4243, 4246, 4268, 4274, 4359, 4365, 4384, 4387, 4390, 4393, 4396, 4411, 4416, 4421, 3826, 3859, 3861, 3862, 3894, 3896, 3897, 3898, 3929, 3931, 3934, 3968, 3969, 3970, 4001, 4003, 4006, 4040, 4041, 4042, 4073, 4075, 4078, 4112, 4113, 4114, 4145, 4147, 4149, 4182, 4184, 4185, 4187, 4188, 4191, 4195, 4199, 4201, 4203, 4204, 4431, 4433, 4434, 4439, 4444, 4449, 4451, 4454]
39, 487, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 60, 64, 67, 68, 72, 73, 77, 78, 81, 82, 83, 87, 94, 95, 98, 99, 100, 102, 103, 104, 105, 109, 112, 113, 117, 118, 120, 122, 123, 124, 125, 126, 127, 128, 132, 139, 140, 144, 145, 147, 149, 150, 154, 157, 158, 162, 163, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 250, 251, 252, 253, 256, 257, 258, 259, 262, 263, 264, 265, 267, 268, 269, 270, 271, 272, 273, 274, 275, 276, 277, 280,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

281, 282, 283, 286, 287, 288, 289, 292, 293, 294, 295, 296, 297, 298, 299, 300, 301, 302, 303, 304, 305, 306, 307, 310, 311, 312, 315, 316, 317, 318, 319, 322, 323, 324, 325, 326, 327, 328, 329, 330, 331, 332, 333, 334, 335, 336, 337, 340, 341, 342, 343, 345, 346, 347, 348, 351, 352, 353, 354, 355, 356, 357, 358, 359, 360, 361, 362, 363, 364, 365, 366, 367, 370, 371, 372, 374, 375, 376, 377, 378, 379, 382, 383, 384, 385, 386, 387, 388, 389, 390, 391, 392, 393, 394, 395, 396, 397, 400, 401, 402, 403, 406, 407, 408, 409, 412, 413, 414, 415, 416, 417, 418, 419, 420, 421, 422, 423, 424, 425, 426, 427, 430, 431, 432, 433, 436, 437, 438, 439, 442, 443, 444, 445, 446, 447, 448, 449, 450, 452, 454, 455, 456, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2392, 2399, 2449, 2458, 2572, 2579, 2629, 2638, 2684, 2691, 2721, 2730, 2752, 2759, 2769, 2778, 2792, 2799, 2809, 2818, 3018, 3036, 3038, 3056, 3058, 3076, 3078, 3096, 3707, 3789, 655, 1153, 1192, 1305, 1307, 1309, 1312, 1319, 1320, 1322, 1323, 1329, 1330, 1332, 1333, 1339, 1340, 1342, 1343, 1349, 1357, 1359, 1361, 1362, 1363, 1365, 1366, 1367, 1369, 1370, 1373, 1375, 1379, 1380, 1381, 1383, 1384, 1385, 1387, 1388, 1389, 1391, 1393, 1497, 1502, 1507, 1512, 1543, 1548, 1563, 1568, 1723, 1728, 1733, 1738, 1743, 1748, 3936, 3944, 3960, 3980, 3995, 4008, 4032, 4080, 4104, 4210, 4214, 4218, 4231, 4237, 4240, 4243, 4268, 4276, 4304, 4359, 4384, 4387, 4390, 4396, 4411, 4416, 4421, 3826, 3859, 3861, 3862, 3894, 3896, 3897, 3898, 3929, 3931, 3934, 3968, 3969, 3970, 4001, 4003, 4006, 4040, 4041, 4042, 4073, 4075, 4078, 4112, 4113, 4114, 4145, 4147, 4149, 4182, 4184, 4185, 4187, 4188, 4191, 4195, 4199, 4201, 4203, 4204, 4431, 4433, 4434, 4439, 4444, 4449, 4451, 4454]

40, 478, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 60, 64, 67, 68, 72, 73, 77, 78, 82, 83, 87, 94, 95, 99, 100, 102, 104, 105, 109, 112, 113, 117, 118, 122, 123, 126, 127, 128, 132, 139, 140, 144, 145, 149, 150, 154, 157, 158, 162, 163, 167, 168, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 250, 251, 252, 253, 256, 257, 258, 259, 262, 263, 264, 265, 267, 268, 269, 270, 271, 272, 273, 274, 275, 276, 277, 280, 281, 282, 283, 286, 287, 288, 289, 292, 293, 294, 295, 296, 297, 298, 299, 300, 301, 302, 303, 304, 305, 306, 307, 310, 311, 312, 313, 316, 317, 318, 319, 322, 323, 324, 325, 326, 327, 328, 329, 330, 331, 332, 333, 334, 335, 336, 337, 340, 341, 342, 345, 346, 347, 348, 349, 352, 353, 354, 355, 356, 357, 358, 359, 360, 361, 362, 363, 364, 365, 366, 367, 370, 371, 372, 373, 376, 377, 378, 379, 382, 383, 384, 385, 386, 387, 388, 389, 390, 391, 392, 393, 394, 395, 396, 397, 400, 401, 402, 403, 406, 407, 408, 409, 412, 413, 414, 415, 416, 417, 418, 419, 420, 421, 422, 423, 424, 425, 426, 427, 430, 431, 432, 433, 436, 437, 438, 439, 442, 443, 444, 445, 446, 447, 448, 449, 450, 452, 454, 455, 456, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2392, 2399, 2449, 2458, 2572, 2579, 2589, 2598, 2612, 2619, 2629, 2638, 2752, 2759, 2809, 2818, 3018, 3036, 3038, 3056, 3058, 3076, 3078, 3096, 3707, 3789, 745, 1145, 1184, 1305, 1307, 1309, 1312, 1319, 1320, 1322, 1323, 1329, 1330, 1332, 1333, 1339, 1340, 1342, 1343, 1349, 1357, 1359, 1361, 1362, 1363, 1365, 1366, 1367, 1369, 1370, 1373, 1375, 1379, 1380, 1381, 1383, 1384, 1385, 1387, 1388, 1389, 1391, 1393, 1497, 1502, 1507, 1512, 1543, 1548, 1553, 1558, 1563, 1568, 1633, 1638, 1653, 1658, 1677, 1682, 1687, 1692, 1723, 1728, 1733, 1738, 1743, 1748, 3936, 3960, 4008, 4016, 4032, 4080, 4104, 4210, 4214, 4218, 4231, 4237, 4243, 4270, 4298, 4384, 4390, 4396, 4411, 4416, 4421, 3826, 3859, 3861, 3862, 3894, 3896, 3897, 3898, 3929, 3931, 3934, 3968, 3969, 3970, 4001, 4003, 4006, 4040, 4041, 4042, 4073, 4075, 4078, 4112, 4113, 4114, 4145, 4147, 4149, 4182, 4184, 4185, 4187, 4188, 4191, 4195, 4199, 4201, 4203, 4204, 4431, 4433, 4434, 4439, 4444, 4449, 4451, 4454]

41, 493, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 72, 73, 74, 75, 76, 77, 78, 79, 80, 81, 82, 83, 84, 85, 86, 87, 94, 95, 99, 100, 104, 105, 109, 112, 113, 115, 117, 118, 122, 123, 127, 128, 130, 132, 136, 138, 139, 140, 142, 144, 145, 149, 150, 151, 152, 153, 154, 157, 158, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 271, 272, 273, 274, 275, 276, 278, 279, 280, 281, 282, 284, 285, 286, 287, 288, 290, 291, 292, 293, 294, 295, 296, 297, 298, 299, 300, 301, 302, 303, 304, 305, 306, 307, 310, 311, 312, 313, 316, 317, 318, 319, 322, 323, 324, 325, 326, 327, 328, 329, 330, 331, 332, 333, 334, 335, 336, 337, 340, 341, 342, 343, 346, 347, 348, 349, 352, 353, 354, 355, 356, 357, 358, 359, 360, 361, 362, 363, 364, 365, 366, 369, 370, 371, 372, 373, 376, 377, 378, 379, 382, 383, 384, 385, 386, 387, 388, 389, 390, 391, 392, 393, 394, 395, 396, 397, 399, 400, 401, 402, 403, 406, 407, 408, 411, 412, 413, 414, 415, 416, 417, 418, 419, 420, 421, 422, 423, 424, 425, 426, 427, 428, 429, 430, 431, 432, 435, 436, 437, 438, 439, 441, 442, 443, 444, 445, 446, 447, 448, 449, 450, 452, 454, 455, 456, 458, 460, 461, 462, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2572, 2579, 2629, 2638, 2681, 2690, 2724, 2731, 2772, 2779, 2789, 2798, 3018, 3036, 3038, 3056, 3058, 3076, 3078, 3096, 3707, 3789, 1305, 1307, 1309, 1312, 1319, 1322, 1329, 1332, 1339, 1342, 1349, 1357, 1361, 1365, 1369, 1373, 1375, 1379, 1383, 1387, 1391, 1393, 1497, 1587, 1592, 1597, 1602, 1643, 1648, 4263, 4269, 4275, 4291, 4294, 4297, 4303, 4322, 4336, 4360, 4364, 4388, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

42, 477, [1, 3, 6, 7, 8, 11, 12, 13, 16, 17, 18, 23, 25, 27, 28, 29, 30, 31, 32, 33, 34, 35, 36, 37, 38, 39, 40, 41, 42, 49, 50, 54, 55, 59, 60, 64, 67, 68, 72, 73, 77, 78, 82, 83, 87, 94, 95, 99, 100, 104, 105, 106, 108, 109, 112, 113, 115, 117, 118, 119, 121, 122, 123, 127, 128, 132, 139, 140, 144, 145, 146, 148, 149, 150, 151, 152, 153, 154, 157, 158, 160, 162, 163, 164, 165, 166, 167, 168, 169, 171, 172, 173, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 250, 251, 252, 253, 256, 257, 258, 259, 262, 263, 264, 265, 267, 268, 269, 270, 271, 272, 273, 274, 275, 276, 277, 281, 282, 283, 287, 288, 289, 293, 294, 295, 296, 297, 298, 299, 300, 301, 302, 303, 304, 305, 306, 309, 311, 312, 313, 317, 318, 319, 323, 324, 325, 326, 327, 328, 329, 330, 331, 332, 333, 334, 335, 336, 337, 341, 342, 343, 347, 348, 351, 353, 354, 355, 356, 357, 358, 359, 360, 361, 362, 363, 364, 365, 366, 367, 368, 369, 370, 371, 372, 375, 377, 378, 379, 383, 384, 385, 386, 387, 388, 389, 390, 391, 392, 393, 394, 395, 396, 397, 401, 402, 405, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 441, 443, 444, 445, 446, 447, 448, 449, 450, 452, 454, 455, 456, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2392, 2449, 2501, 2572, 2609, 2701, 2752, 2769, 2901, 3018, 3036, 3038, 3056, 3058, 3076, 3078, 3096, 3254, 3270, 3286, 3335, 3447, 3511, 3591, 3687, 3707, 3735, 3789, 1305, 1307, 1309, 1312, 1316, 1318, 1319, 1322, 1323, 1326, 1329, 1332, 1333, 1336, 1339, 1342, 1343, 1349, 1357, 1359, 1361, 1362, 1363, 1365, 1366, 1367, 1369, 1370, 1373, 1375, 1379, 1383, 1387, 1389, 1391, 1393, 1497, 1507, 1553, 1563, 1587, 1653, 1968, 1976, 2000, 2008, 2056, 2080, 3902, 3926, 3945, 3960, 3974, 3990, 4025, 4032, 4046, 4054, 4104, 4105, 4210, 4214, 4218, 4231, 4237, 4243, 4262, 4304, 4328, 4358, 4394, 4411, 3826, 3859, 3861, 3862, 3894, 3896, 3897, 3929, 3933, 3934, 3968, 3969, 4001, 4003, 4005, 4006, 4040, 4041, 4073, 4075, 4077, 4078, 4112, 4113, 4114, 4145, 4147, 4149, 4182, 4184, 4185, 4187, 4188, 4191, 4195, 4199, 4201, 4203, 4204, 4431, 4433, 4434, 4436, 4438, 4439, 4441, 4443, 4444, 4446, 4449, 4451, 4454]

43, 383, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 51, 52, 53, 56, 57, 58, 61, 62, 63, 67, 94, 112, 139, 157, 160, 162, 164, 165, 166, 169, 170, 171, 173, 174, 175, 176, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

241, 243, 244, 245, 246, 250, 251, 252, 256, 257, 258, 262, 263, 264, 265, 267, 268, 269, 270, 271, 272, 273, 274, 275, 276, 280, 282, 286, 288, 292, 294, 295, 296, 297, 298, 299, 300, 301, 302, 303, 304, 305, 324, 325, 326, 327, 328, 329, 330, 331, 332, 333, 334, 335, 354, 355, 356, 357, 358, 359, 360, 361, 362, 363, 364, 365, 384, 385, 386, 387, 388, 389, 390, 391, 392, 393, 394, 395, 414, 415, 416, 417, 418, 419, 420, 421, 422, 423, 424, 425, 431, 437, 443, 444, 445, 446, 447, 448, 449, 450, 452, 454, 455, 456, 460, 461, 462, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2406, 2424, 2426, 2444, 2446, 2464, 2839, 2859, 2873, 2879, 2893, 2913, 3018, 3036, 3038, 3056, 3058, 3076, 3078, 3096, 3707, 3789, 631, 662, 721, 752, 1013, 1021, 1029, 1174, 1182, 1190, 1305, 1307, 1309, 1312, 1319, 1320, 1321, 1322, 1323, 1324, 1325, 1326, 1327, 1328, 1329, 1330, 1331, 1332, 1333, 1334, 1335, 1336, 1337, 1338, 1339, 1342, 1349, 1357, 1361, 1365, 1369, 1373, 1375, 1379, 1383, 1387, 1391, 1393, 3936, 3939, 3960, 3964, 3971, 3974, 3994, 3998, 4008, 4011, 4032, 4036, 4043, 4046, 4066, 4070, 4233, 4239, 4245, 4261, 4265, 4267, 4271, 4273, 4277, 4354, 4360, 4366, 4382, 4386, 4388, 4392, 4394, 4398, 3826, 3859, 3861, 3862, 3894, 3896, 3897, 3898, 3929, 3931, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
44, 443, [1, 3, 6, 7, 8, 11, 12, 13, 16, 17, 18, 23, 25, 27, 29, 30, 31, 32, 34, 35, 36, 37, 38, 39, 40, 41, 42, 46, 48, 49, 52, 53, 54, 57, 58, 59, 61, 62, 63, 64, 67, 70, 72, 76, 82, 85, 86, 87, 93, 94, 99, 108, 109, 112, 115, 117, 130, 132, 138, 139, 142, 143, 144, 153, 154, 157, 160, 162, 165, 166, 167, 170, 171, 172, 173, 175, 176, 177, 181, 183, 184, 185, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 246, 249, 250, 251, 252, 255, 256, 257, 258, 261, 262, 263, 264, 265, 267, 268, 269, 270, 271, 272, 273, 274, 275, 276, 278, 279, 280, 281, 284, 286, 287, 290, 291, 292, 293, 294, 295, 296, 297, 298, 299, 300, 301, 302, 303, 304, 305, 308, 309, 310, 311, 316, 320, 322, 323, 324, 325, 326, 327, 328, 329, 330, 331, 332, 333, 334, 335, 338, 339, 340, 341, 352, 353, 354, 355, 356, 357, 358, 359, 360, 361, 362, 363, 364, 365, 369, 370, 371, 382, 383, 384, 385, 386, 387, 388, 389, 390, 391, 392, 393, 394, 395, 399, 400, 401, 407, 411, 412, 413, 414, 415, 416, 417, 418, 419, 420, 421, 422, 423, 424, 425, 427, 428, 429, 430, 431, 435, 436, 437, 441, 442, 443, 444, 445, 446, 447, 448, 449, 450, 452, 454, 455, 456, 458, 460, 461, 464, 466, 467, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2318, 2338, 2516, 2531, 2571, 2630, 2751, 2798, 2801, 2810, 2815, 2839, 2862, 2903, 2967, 2987, 3018, 3036, 3038, 3056, 3058, 3076, 3078, 3096, 3163, 3267, 3363, 3486, 3522, 3567, 3586, 3679, 3707, 3789, 596, 631, 645, 656, 662, 690, 691, 702, 709, 721, 752, 981, 989, 1013, 1064, 1108, 1112, 1174, 1187, 1222, 1223, 1230, 1305, 1307, 1309, 1312, 1319, 1322, 1329, 1332, 1339, 1342, 1349, 1357, 1361, 1365, 1369, 1373, 1375, 1379, 1383, 1387, 1391, 1393, 1498, 1508, 1544, 1564, 1734, 2014, 4019, 4028, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
45, 350, [8, 12, 28, 29, 30, 31, 32, 33, 34, 35, 36, 37, 39, 41, 50, 51, 52, 53, 54, 55, 56, 57, 58, 60, 62, 68, 72, 73, 74, 78, 79, 83, 84, 87, 89, 94, 95, 96, 100, 101, 105, 112, 113, 117, 118, 119, 123, 124, 128, 129, 132, 140, 141, 145, 146, 150, 157, 162, 163, 164, 165, 166, 168, 169, 170, 171, 174, 176, 177, 185, 186, 187, 188, 190, 191, 192, 193, 194, 197, 198, 199, 214, 216, 233, 236, 251, 252, 253, 256, 257, 258, 259, 263, 269, 276, 277, 279, 280, 281, 282, 283, 286, 288, 289, 292, 294, 295, 297, 298, 299, 305, 306, 307, 308, 309, 310, 311, 312, 313, 318, 319, 324, 325, 326, 327, 328, 329, 330, 331, 333, 335, 336, 337, 338, 339, 340, 341, 342, 343, 348, 349, 354, 355, 356, 357, 358, 359, 360, 362, 364, 365, 366, 367, 368, 369, 370, 371, 372, 373, 378, 379, 384, 385, 386, 387, 388, 389, 390, 394, 396, 397, 398, 399, 400, 401, 402, 403, 408, 409, 414, 415, 416, 417, 418, 419, 426, 428, 430, 431, 432, 433, 437, 438, 439, 443, 444, 446, 448, 449, 456, 460, 462, 466, 467, 468, 472, 473, 474, 486, 488, 489, 491, 2247, 2261, 2299, 2313, 2359, 2373, 2444, 2464, 2764, 2826, 2873, 2893, 2964, 2986, 3038, 3056, 3058, 3076, 3130, 3208, 3306, 3341, 3357, 3400, 3664, 3680, 3691, 3781, 505, 543, 582, 585, 626, 896, 913, 934, 950, 962, 1006, 1047, 1165, 1253, 1277, 1302, 1322, 1329, 1332, 1337, 1361, 1365, 1367, 1383, 1387, 2003, 2011, 2043, 2051, 2083, 2091, 3836, 3851, 3855, 3866, 3895, 3901, 3904, 3930, 3932, 3945, 3962, 3979, 3983, 3996, 4000, 4017, 4034, 4051, 4055, 4068, 4072, 4079, 4082, 4109, 4111, 4117, 4120, 4146, 4162, 4177, 4190, 4202, 4209, 4212, 4221, 4224, 4228, 4239, 4245, 4260, 4271, 4277, 4347, 4360, 4366, 4375, 4379, 4392, 4398, 4412, 4427, 4435, 4437, 4452, 3933, 3934, 3966, 3969, 3970, 4001, 4003, 4005, 4006, 4038, 4040, 4041, 4042, 4075, 4192, 4193, 4195, 4196, 4199, 4438, 4439, 4441, 4443, 4444, 4446]
46, 459, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 51, 52, 53, 54, 56, 57, 58, 59, 61, 62, 63, 64, 67, 72, 77, 82, 87, 94, 99, 104, 109, 112, 117, 122, 125, 126, 127, 128, 129, 130, 131, 132, 136, 138, 139, 140, 141, 142, 143, 144, 147, 149, 154, 157, 160, 162, 163, 164, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 249, 250, 251, 252, 255, 256, 257, 258, 261, 262, 263, 264, 265, 267, 268, 269, 270, 271, 272, 273, 274, 275, 276, 280, 281, 282, 286, 287, 288, 292, 293, 294, 295, 296, 297, 298, 299, 300, 301, 302, 303, 304, 305, 310, 311, 316, 317, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 370, 371, 375, 376, 377, 381, 382, 383, 384, 385, 386, 387, 388, 389, 390, 391, 392, 393, 394, 395, 396, 397, 399, 400, 401, 402, 403, 405, 406, 407, 412, 413, 414, 415, 416, 417, 418, 419, 420, 421, 422, 423, 424, 425, 429, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2406, 2426, 2446, 2579, 2638, 2699, 2799, 2818, 2839, 3018, 3036, 3038, 3056, 3058, 3076, 3078, 3096, 3498, 3707, 3789, 631, 662, 721, 1013, 1021, 1029, 1094, 1102, 1143, 1190, 1305, 1307, 1309, 1312, 1319, 1320, 1322, 1323, 1325, 1327, 1329, 1330, 1332, 1337, 1339, 1342, 1349, 1357, 1361, 1365, 1369, 1373, 1375, 1379, 1383, 1387, 1391, 1393, 1498, 1508, 1558, 1568, 1592, 1602, 1638, 3936, 3960, 3971, 3994, 4008, 4016, 4057, 4066, 4233, 4239, 4245, 4261, 4267, 4273, 4294, 4300, 4334, 4366, 4382, 3826, 3859, 3861, 3862, 3894, 3896, 3897, 3898, 3929, 3931, 3934, 3968, 3970, 4003, 4006, 4038, 4040, 4041, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
47, 392, [12, 30, 37, 49, 57, 64, 75, 82, 91, 93, 94, 96, 97, 99, 102, 109, 120, 123, 125, 127, 128, 129, 130, 131, 132, 136, 138, 139, 140, 141, 142, 144, 147, 154, 172, 173, 174, 175, 176, 177, 181, 183, 184, 185, 186, 187, 188, 189, 190, 191, 192, 193, 195, 196, 197, 198, 199, 205, 206, 209, 210, 211, 214, 215, 216, 219, 220, 221, 227, 233, 236, 246, 247, 249, 250, 251, 255, 258, 259, 261, 263, 264, 265, 267, 268, 269, 270, 271, 272, 273, 274, 275, 282, 283, 284, 285, 286, 287, 288, 289, 290, 291, 292, 293, 306, 307, 308, 309, 310, 311, 314, 315, 318, 319, 320, 321, 322, 323, 324, 325, 326, 327, 328, 329, 330, 331, 332, 333, 334, 335, 341, 342, 343, 344, 345, 346, 347, 348, 349, 350, 351, 352, 353, 366, 367, 368, 369, 370, 371, 374, 375, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 426, 427, 428, 429, 430, 431, 438, 439, 440, 441, 442, 443, 444, 445, 446, 447, 448, 449, 450, 452, 454, 455, 456, 458, 460, 461, 462, 464, 466, 467, 468, 470, 472, 473, 479, 480, 483, 485, 486, 488, 489, 491, 492, 494, 2207, 2221, 2250, 2257, 2267, 2281, 2343, 2352, 2430, 2437, 2523, 2532, 2587, 2610, 2617, 2703, 2712, 2790, 2797, 2981, 3007, 3013, 3018, 3036, 3038, 3056, 3058, 3076, 3078, 3096, 3122, 3208, 3707, 3789, 497, 505, 527, 542, 551, 559, 572, 595, 606, 614, 632, 641, 649, 662, 696, 722, 731, 739, 786, 812, 821, 825, 829, 1206, 1222, 1224, 1305, 1306, 1312, 1313, 1314, 1315, 1316, 1322, 1323, 1324, 1332, 1342, 1347, 1349, 1357, 1361, 1363, 1369, 1375, 1376, 1377, 1378, 1379, 1383, 1384, 1387, 1391, 1393, 3830, 3836, 3847, 3853, 3865, 3868, 3885, 3888, 3889, 3892, 3899, 3902, 3908, 3912, 3921, 3925, 3937, 3940, 3957, 3960, 3961, 3964, 3991,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

3993, 3997, 4009, 4012, 4063, 4065, 4069, 4081, 4084, 4094, 4098, 4292, 4296, 4378, 4390, 4426, 4429, 3969, 3970, 4038, 4040, 4041, 4042, 4110, 4112, 4113, 4114, 4147, 4149, 4182, 4184, 4185, 4187, 4188, 4192, 4195, 4196, 4197, 4199, 4200, 4436, 4438, 4439, 4443, 4444, 4446, 4448, 4449, 4451, 4454]
48, 408, [3, 18, 23, 25, 27, 28, 29, 31, 32, 33, 34, 36, 37, 38, 39, 40, 41, 42, 48, 49, 54, 60, 63, 67, 72, 87, 94, 112, 117, 132, 139, 157, 158, 160, 162, 164, 173, 175, 176, 177, 183, 184, 185, 186, 188, 189, 190, 191, 193, 194, 195, 198, 199, 202, 205, 206, 211, 219, 220, 227, 230, 231, 233, 234, 236, 239, 240, 241, 243, 244, 245, 246, 247, 249, 250, 251, 252, 253, 256, 257, 258, 259, 262, 263, 264, 265, 267, 268, 269, 270, 271, 272, 273, 274, 275, 276, 277, 278, 279, 280, 281, 282, 286, 288, 292, 294, 295, 296, 297, 298, 299, 300, 301, 302, 303, 304, 305, 306, 307, 308, 309, 310, 311, 324, 325, 326, 327, 328, 329, 330, 331, 332, 333, 334, 335, 336, 337, 338, 339, 340, 341, 354, 355, 356, 357, 358, 359, 360, 361, 362, 363, 364, 365, 366, 367, 368, 369, 370, 371, 384, 385, 386, 387, 388, 389, 390, 391, 392, 393, 394, 395, 396, 397, 398, 399, 400, 401, 414, 415, 416, 417, 418, 419, 420, 421, 422, 423, 424, 425, 426, 427, 428, 429, 430, 431, 433, 437, 439, 443, 444, 445, 446, 447, 448, 449, 450, 452, 454, 455, 456, 458, 460, 461, 462, 463, 466, 467, 468, 469, 472, 473, 474, 476, 478, 479, 480, 483, 485, 486, 488, 489, 491, 492, 494, 2207, 2221, 2227, 2232, 2238, 2241, 2247, 2252, 2258, 2261, 2267, 2281, 2287, 2293, 2406, 2409, 2419, 2426, 2429, 2439, 2444, 2464, 2859, 2870, 2873, 2879, 2884, 2890, 2893, 2904, 3018, 3036, 3038, 3041, 3056, 3058, 3061, 3071, 3076, 3078, 3091, 3096, 3707, 3789, 686, 705, 776, 795, 1021, 1029, 1068, 1076, 1182, 1190, 1227, 1235, 1305, 1307, 1309, 1312, 1319, 1322, 1329, 1332, 1339, 1342, 1349, 1357, 1361, 1364, 1365, 1368, 1369, 1373, 1375, 1379, 1382, 1383, 1386, 1387, 1391, 1393, 1856, 1860, 1883, 1886, 1891, 1894, 1923, 1931, 2126, 2134, 2163, 2166, 2171, 2174, 2193, 2197, 3835, 3852, 3907, 3924, 3941, 3945, 3958, 3962, 3979, 3983, 3996, 4000, 4013, 4017, 4030, 4034, 4051, 4055, 4068, 4072, 4123, 4140, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4200, 4201, 4203, 4204, 4431, 4433, 4434, 4436, 4448, 4449, 4451, 4454]
49, 438, [1, 3, 6, 7, 8, 11, 12, 13, 16, 17, 18, 23, 25, 29, 30, 31, 34, 35, 36, 39, 40, 41, 42, 49, 67, 70, 72, 74, 76, 83, 85, 91, 93, 94, 99, 105, 106, 107, 108, 112, 117, 128, 130, 132, 136, 138, 139, 144, 148, 151, 152, 153, 154, 157, 158, 160, 162, 164, 166, 167, 173, 175, 177, 181, 183, 184, 185, 186, 187, 188, 189, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 250, 252, 256, 258, 262, 264, 265, 267, 268, 269, 270, 271, 272, 273, 274, 275, 294, 295, 296, 297, 298, 299, 300, 301, 302, 303, 304, 305, 311, 317, 323, 324, 325, 326, 327, 328, 329, 330, 331, 332, 333, 334, 335, 336, 337, 339, 340, 341, 348, 352, 354, 355, 356, 357, 358, 359, 360, 361, 362, 363, 364, 365, 366, 367, 368, 369, 370, 371, 378, 379, 380, 381, 382, 383, 384, 385, 386, 387, 388, 389, 390, 391, 392, 393, 394, 395, 396, 397, 398, 399, 400, 401, 413, 414, 415, 416, 417, 418, 419, 420, 421, 422, 423, 424, 425, 426, 427, 428, 429, 430, 431, 432, 433, 435, 437, 438, 439, 440, 441, 442, 443, 444, 445, 446, 447, 448, 449, 450, 452, 454, 455, 456, 458, 460, 461, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2316, 2318, 2336, 2338, 2356, 2358, 2479, 2499, 2513, 2553, 2644, 2807, 2967, 3018, 3036, 3038, 3056, 3058, 3076, 3078, 3096, 3339, 3354, 3672, 3707, 3789, 654, 742, 785, 832, 973, 981, 989, 1014, 1030, 1063, 1071, 1109, 1113, 1142, 1144, 1148, 1305, 1307, 1309, 1312, 1315, 1316, 1317, 1318, 1319, 1322, 1329, 1332, 1339, 1342, 1349, 1357, 1359, 1360, 1361, 1362, 1363, 1364, 1365, 1366, 1367, 1368, 1369, 1370, 1373, 1375, 1379, 1383, 1385, 1386, 1387, 1391, 1393, 3899, 3902, 3922, 3926, 3952, 3953, 3956, 3977, 3981, 3988, 3992, 4013, 4017, 4024, 4028, 4049, 4053, 4060, 4093, 4096, 4097, 4100, 4210, 4214, 4218, 4231, 4234, 4235, 4237, 4241, 4243, 4246, 4247, 4262, 4266, 4272, 4278, 4330, 4364, 4368, 4416, 4419, 3826, 3859, 3861, 3862, 3894, 3896, 3933, 3934, 3966, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4201, 4203, 4204, 4431, 4433, 4434, 4436, 4438, 4439, 4441, 4446, 4448, 4449, 4451, 4454]
50, 441, [1, 3, 6, 7, 8, 11, 12, 13, 16, 17, 18, 23, 25, 27, 28, 29, 30, 31, 32, 34, 35, 36, 37, 38, 39, 40, 41, 42, 46, 48, 49, 54, 60, 61, 62, 63, 67, 72, 83, 85, 87, 91, 93, 94, 99, 106, 108, 109, 112, 113, 115, 117, 119, 121, 122, 128, 130, 132, 138, 139, 151, 152, 153, 157, 181, 183, 184, 186, 187, 188, 191, 192, 193, 196, 197, 198, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 271, 272, 273, 274, 275, 276, 277, 278, 279, 280, 281, 288, 292, 294, 295, 296, 297, 298, 299, 300, 301, 302, 303, 304, 305, 306, 307, 308, 309, 310, 311, 312, 318, 319, 320, 321, 322, 323, 324, 325, 326, 327, 328, 329, 330, 331, 332, 333, 334, 335, 336, 337, 338, 339, 340, 341, 353, 354, 355, 356, 357, 358, 359, 360, 361, 362, 363, 364, 365, 366, 368, 370, 371, 377, 378, 380, 382, 383, 384, 385, 386, 387, 388, 389, 390, 391, 392, 393, 394, 395, 396, 400, 408, 412, 414, 415, 416, 417, 418, 419, 420, 421, 422, 423, 424, 425, 444, 445, 446, 447, 448, 449, 450, 452, 454, 455, 461, 467, 473, 474, 476, 478, 479, 480, 483, 485, 486, 488, 489, 491, 492, 494, 2207, 2221, 2227, 2241, 2247, 2261, 2267, 2281, 2287, 2293, 2338, 2464, 2627, 2679, 2766, 2784, 2806, 2824, 2947, 2961, 2967, 2981, 2987, 3001, 3018, 3036, 3038, 3056, 3058, 3076, 3078, 3096, 3349, 3499, 3707, 3789, 605, 642, 646, 652, 654, 658, 698, 742, 744, 777, 811, 842, 1029, 1061, 1143, 1173, 1189, 1214, 1222, 1224, 1228, 1230, 1305, 1307, 1309, 1312, 1319, 1322, 1329, 1332, 1339, 1340, 1341, 1342, 1343, 1344, 1349, 1357, 1361, 1363, 1364, 1365, 1369, 1373, 1375, 1379, 1380, 1381, 1382, 1383, 1384, 1385, 1386, 1387, 1388, 1389, 1390, 1391, 1393, 3905, 3909, 3916, 3920, 3941, 3945, 3952, 3956, 3977, 3981, 3990, 4024, 4025, 4028, 4053, 4060, 4064, 4080, 4083, 4104, 4108, 4237, 4241, 4245, 4269, 4304, 4308, 4332, 4353, 4365, 4381, 4384, 4385, 4390, 4393, 4396, 4397, 4411, 4414, 4416, 4419, 4421, 4424, 3826, 3859, 3861, 3862, 3894, 3896, 3897, 3898, 3929, 3931, 3933, 3934, 3966, 3968, 3969, 3970, 4001, 4003, 4005, 4006, 4038, 4040, 4041, 4042, 4073, 4075, 4113, 4114, 4145, 4147, 4149, 4182, 4184, 4185, 4187, 4188, 4189, 4191, 4192, 4196, 4197, 4199, 4200, 4201, 4203, 4204, 4431, 4433, 4434, 4451, 4454]
51, 306, [28, 30, 34, 35, 36, 48, 51, 52, 55, 56, 57, 58, 60, 62, 81, 89, 93, 108, 116, 134, 138, 153, 161, 171, 179, 181, 183, 185, 186, 187, 188, 190, 191, 192, 196, 197, 198, 205, 209, 210, 214, 215, 219, 220, 249, 252, 253, 255, 261, 276, 277, 279, 282, 283, 284, 285, 288, 297, 303, 306, 307, 308, 309, 312, 314, 324, 325, 327, 330, 331, 333, 336, 337, 338, 339, 342, 354, 355, 356, 357, 360, 361, 362, 363, 366, 367, 368, 369, 384, 385, 386, 387, 390, 391, 392, 393, 396, 397, 398, 399, 414, 415, 416, 417, 420, 421, 422, 423, 426, 427, 428, 429, 432, 433, 435, 444, 445, 446, 447, 450, 452, 453, 456, 458, 459, 462, 464, 465, 471, 474, 476, 477, 480, 483, 486, 489, 492, 2247, 2332, 2339, 2372, 2406, 2417, 2460, 2492, 2606, 2787, 2980, 2987, 3018, 3029, 3038, 3049, 3058, 3069, 3078, 3089, 3101, 3125, 3162, 3290, 3306, 3348, 3585, 3707, 508, 517, 571, 585, 642, 651, 655, 686, 688, 697, 705, 776, 778, 787, 795, 822, 831, 835, 950, 958, 975, 998, 1006, 1029, 1033, 1039, 1047, 1072, 1101, 1142, 1230, 1322, 1329, 1332, 1339, 1342, 1349, 1365, 1375, 1379, 1381, 1383, 1387, 1388, 1391, 1393, 1887, 1919, 1927, 1935, 1959, 1967, 1983, 1991, 1999, 2007, 2023, 2031, 2039, 2063, 2071, 2079, 2103, 2111, 2119, 2127, 2143, 2151, 2159, 2167, 2183, 2187, 2191, 2195, 2199, 2203, 3845, 3865, 3887, 3901, 3930, 3941, 3944, 3945, 3958, 3962, 3979, 3982, 3996, 4013, 4017, 4030, 4034, 4051, 4061, 4068, 4085, 4088, 4089, 4102, 4106, 4190, 4198, 4217, 4223, 4228, 4299, 4327, 4330, 4358, 4396, 4421, 3933, 3966, 3969, 3970, 4001, 4003, 4005, 4038, 4041, 4042, 4073, 4075, 4077, 4110, 4113, 4114, 4145, 4147, 4149, 4182, 4193, 4196, 4431, 4433, 4436, 4441, 4443, 4448, 4451]
52, 484, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 54, 55, 56, 57, 58, 59, 60, 61, 62, 63, 64, 67, 68, 70, 72, 73, 76, 77, 78, 80, 82, 83, 84, 85, 86, 87, 91, 93, 94, 95, 97, 99, 100, 104, 105, 108, 109, 112, 113, 117, 118, 122, 123, 127, 128, 130, 132, 139, 140, 144, 145, 149, 150, 154, 157, 158, 162, 163, 167, 168, 172, 173, 175, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 255, 256, 257, 258, 259, 261, 262, 263, 264, 265, 267,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

268, 269, 270, 271, 272, 273, 274, 275, 276, 277, 278, 279, 280, 281, 282, 284, 285, 286, 287, 288, 290, 291, 292, 293, 294, 295, 296, 297, 298, 299, 300, 301, 302, 303, 304, 305, 306, 308, 309, 310, 311, 312, 313, 316, 317, 318, 320, 321, 322, 323, 324, 325, 326, 327, 328, 329, 330, 331, 332, 333, 334, 335, 336, 338, 339, 340, 341, 342, 343, 346, 347, 348, 349, 352, 353, 354, 356, 357, 358, 359, 360, 361, 362, 363, 364, 365, 366, 367, 370, 371, 372, 373, 376, 377, 378, 379, 382, 383, 384, 385, 386, 387, 388, 389, 390, 391, 392, 393, 394, 395, 396, 397, 400, 401, 402, 403, 406, 407, 408, 409, 412, 413, 414, 415, 418, 419, 420, 421, 422, 423, 424, 425, 426, 427, 430, 431, 432, 435, 436, 437, 438, 439, 442, 443, 444, 445, 446, 447, 448, 449, 450, 452, 454, 455, 456, 460, 461, 462, 466, 467, 468, 472, 473, 474, 478, 479, 480, 483, 485, 486, 488, 489, 491, 492, 494, 2207, 2221, 2227, 2241, 2247, 2261, 2267, 2281, 2287, 2293, 2524, 2531, 2592, 2599, 2724, 2731, 2752, 2759, 2890, 2904, 2911, 3018, 3036, 3038, 3056, 3058, 3076, 3078, 3096, 3707, 3789, 807, 1305, 1307, 1309, 1312, 1319, 1322, 1329, 1330, 1332, 1338, 1339, 1340, 1342, 1349, 1357, 1361, 1365, 1369, 1373, 1375, 1379, 1380, 1381, 1383, 1385, 1387, 1388, 1391, 1393, 1597, 1602, 1633, 1638, 1643, 1648, 1677, 1682, 1687, 1692, 1697, 1702, 1723, 1728, 3943, 3996, 4008, 4080, 4267, 4297, 4303, 4321, 4333, 4351, 4354, 4369, 4372, 4384, 4388, 4396, 4416, 4421, 3826, 3859, 3861, 3862, 3894, 3896, 3897, 3898, 3929, 3931, 3933, 3934, 3966, 3968, 3969, 3970, 4001, 4003, 4006, 4038, 4040, 4041, 4042, 4073, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4439, 4441, 4444, 4448, 4449, 4451, 4454]
53, 429, [1, 3, 6, 7, 8, 11, 12, 13, 16, 17, 18, 23, 25, 29, 30, 31, 34, 35, 36, 39, 40, 41, 42, 49, 67, 79, 81, 94, 100, 102, 104, 112, 122, 124, 126, 127, 139, 145, 147, 148, 149, 157, 181, 183, 184, 186, 187, 188, 190, 191, 192, 193, 194, 196, 197, 198, 202, 205, 206, 209, 210, 211, 214, 215, 216, 219, 220, 221, 227, 230, 233, 236, 239, 240, 241, 243, 244, 245, 246, 250, 252, 256, 258, 262, 264, 265, 267, 268, 269, 270, 271, 272, 273, 274, 275, 294, 295, 296, 297, 298, 299, 300, 301, 302, 303, 304, 305, 317, 323, 324, 325, 326, 327, 328, 329, 330, 331, 332, 333, 334, 335, 342, 343, 345, 346, 347, 348, 349, 351, 352, 353, 354, 355, 356, 357, 358, 359, 360, 361, 362, 363, 364, 365, 372, 373, 374, 375, 376, 377, 378, 380, 382, 383, 384, 385, 386, 387, 388, 389, 390, 391, 392, 393, 394, 395, 402, 403, 404, 405, 406, 407, 408, 414, 415, 416, 417, 418, 419, 420, 421, 422, 423, 424, 425, 432, 433, 434, 435, 436, 437, 444, 445, 446, 447, 448, 449, 450, 452, 454, 455, 461, 462, 464, 466, 467, 473, 474, 476, 478, 479, 480, 483, 485, 486, 488, 489, 491, 492, 494, 2207, 2221, 2227, 2241, 2247, 2261, 2267, 2281, 2287, 2293, 2316, 2318, 2336, 2338, 2356, 2358, 2499, 2513, 2519, 2533, 2538, 2947, 2961, 2987, 3001, 3018, 3036, 3056, 3058, 3076, 3078, 3096, 3515, 3605, 3707, 3789, 631, 643, 662, 664, 685, 706, 721, 752, 796, 811, 822, 831, 835, 839, 842, 973, 981, 989, 1022, 1030, 1189, 1214, 1230, 1232, 1305, 1307, 1309, 1312, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1349, 1357, 1359, 1360, 1361, 1362, 1363, 1364, 1365, 1366, 1367, 1368, 1369, 1370, 1373, 1375, 1379, 1380, 1381, 1382, 1383, 1387, 1388, 1389, 1390, 1391, 1393, 3899, 3902, 3922, 3926, 3936, 3939, 3946, 3960, 3961, 3964, 3971, 3974, 3980, 3984, 3994, 3995, 3998, 3999, 4008, 4011, 4014, 4018, 4029, 4032, 4033, 4036, 4043, 4046, 4052, 4056, 4066, 4067, 4070, 4080, 4083, 4088, 4092, 4104, 4108, 4210, 4214, 4218, 4231, 4235, 4237, 4240, 4241, 4243, 4246, 4247, 4268, 4272, 4274, 4278, 4365, 4384, 4396, 4397, 4411, 4414, 4421, 4424, 4421, 3826, 3859, 3861, 3862, 3894, 3896, 4113, 4114, 4145, 4147, 4149, 4182, 4184, 4185, 4187, 4188, 4201, 4203, 4204, 4431, 4433, 4434, 4441, 4443, 4444, 4451, 4454]
54, 213, [6, 30, 34, 35, 55, 57, 73, 74, 75, 78, 79, 80, 84, 88, 91, 92, 95, 96, 97, 100, 101, 102, 105, 106, 107, 111, 113, 115, 118, 119, 120, 123, 124, 125, 128, 129, 130, 136, 140, 141, 145, 146, 147, 151, 152, 165, 169, 170, 190, 192, 214, 252, 253, 254, 258, 259, 282, 283, 284, 288, 289, 290, 312, 313, 314, 318, 319, 320, 330, 331, 336, 337, 338, 342, 343, 344, 348, 349, 350, 354, 355, 356, 360, 362, 366, 368, 372, 373, 374, 378, 379, 380, 384, 386, 390, 392, 396, 398, 402, 403, 404, 408, 409, 410, 414, 416, 432, 433, 434, 438, 439, 440, 462, 464, 468, 470, 486, 487, 489, 490, 2247, 2253, 2479, 2485, 2539, 2545, 2746, 2756, 2776, 2806, 2826, 2832, 3038, 3048, 3058, 3068, 3124, 3130, 3200, 3306, 3392, 505, 595, 616, 865, 886, 913, 934, 1006, 1014, 1038, 1047, 1165, 1173, 1197, 1322, 1329, 1332, 1335, 1337, 1361, 1365, 1367, 1383, 1387, 1855, 1859, 1885, 1893, 1925, 1933, 1949, 1957, 1965, 1973, 1981, 1989, 1997, 2005, 2013, 2021, 2029, 2037, 2045, 2053, 2061, 2085, 2093, 2125, 2133, 2165, 2173, 3851, 3870, 3885, 3908, 3923, 4086, 4101, 4124, 4139, 4262, 4280, 4375, 4381, 4399, 3933, 3969, 4001, 4005, 4038, 4193, 4438, 4443]
55, 331, [3, 7, 8, 12, 13, 17, 25, 30, 31, 32, 34, 35, 36, 40, 41, 42, 44, 49, 59, 67, 91, 93, 94, 97, 98, 101, 102, 103, 104, 107, 108, 112, 115, 117, 119, 120, 121, 122, 124, 125, 126, 130, 131, 132, 139, 157, 161, 162, 177, 187, 188, 192, 193, 197, 198, 199, 210, 211, 215, 216, 230, 233, 236, 239, 245, 250, 255, 256, 257, 262, 267, 269, 273, 275, 284, 285, 286, 287, 296, 297, 298, 299, 302, 303, 304, 305, 314, 315, 316, 317, 326, 327, 328, 329, 332, 333, 334, 335, 341, 344, 345, 346, 347, 353, 356, 357, 358, 359, 362, 363, 364, 365, 369, 370, 371, 374, 376, 377, 382, 386, 387, 388, 389, 392, 394, 395, 398, 399, 400, 401, 406, 416, 417, 418, 419, 428, 429, 430, 431, 446, 448, 449, 458, 460, 461, 467, 473, 488, 491, 2210, 2230, 2241, 2250, 2261, 2270, 2281, 2316, 2323, 2356, 2363, 2378, 2590, 2601, 2630, 2641, 2716, 2723, 2804, 2843, 2950, 2961, 2970, 2981, 2991, 3043, 3056, 3063, 3076, 3083, 3224, 3240, 3582, 3637, 3781, 3797, 499, 538, 587, 598, 607, 611, 618, 655, 659, 787, 791, 824, 843, 898, 906, 935, 967, 1016, 1032, 1095, 1111, 1153, 1185, 1192, 1196, 1224, 1248, 1263, 1271, 1302, 1313, 1315, 1316, 1317, 1318, 1320, 1321, 1323, 1324, 1325, 1327, 1335, 1337, 1340, 1359, 1360, 1362, 1363, 1367, 1368, 1370, 1371, 1381, 1382, 1384, 1385, 1386, 1388, 1389, 1850, 1854, 1858, 1862, 1866, 1882, 1898, 1906, 1922, 1938, 1946, 1962, 1978, 1986, 1994, 2002, 2010, 2018, 2026, 2034, 2042, 2058, 2066, 2074, 2098, 2114, 2138, 2154, 2162, 2170, 3860, 3902, 3910, 3926, 3936, 3939, 3944, 3948, 3960, 3964, 4051, 4054, 4055, 4068, 4072, 4089, 4106, 4117, 4120, 4179, 4186, 4208, 4210, 4218, 4235, 4247, 4264, 4276, 4296, 4308, 4377, 4390, 4391, 4396, 4408, 4419, 4424, 4427, 4452, 3861, 3862, 3970, 4003, 4005, 4006, 4038, 4040, 4042, 4075, 4110, 4112, 4188, 4195, 4196, 4203, 4436, 4449]
56, 311, [34, 35, 51, 52, 56, 57, 68, 70, 76, 81, 85, 86, 89, 91, 93, 96, 97, 98, 99, 101, 102, 103, 104, 106, 107, 108, 109, 116, 121, 122, 126, 127, 131, 134, 138, 143, 144, 147, 148, 149, 153, 154, 156, 163, 164, 165, 166, 169, 170, 171, 174, 176, 185, 186, 187, 188, 190, 191, 192, 193, 195, 197, 198, 210, 214, 215, 252, 255, 258, 259, 282, 288, 289, 290, 291, 303, 306, 309, 311, 317, 318, 320, 321, 323, 330, 331, 333, 336, 338, 340, 341, 345, 346, 347, 348, 350, 352, 353, 354, 355, 357, 360, 362, 370, 371, 372, 373, 374, 375, 376, 377, 382, 383, 384, 385, 386, 387, 390, 400, 401, 402, 403, 404, 405, 406, 407, 412, 413, 414, 415, 416, 417, 430, 432, 433, 434, 436, 442, 444, 446, 447, 456, 458, 459, 460, 462, 464, 465, 466, 468, 470, 471, 472, 474, 483, 486, 489, 2325, 2407, 2420, 2426, 2440, 2492, 2493, 2513, 2533, 2539, 2586, 2607, 2626, 2673, 2736, 2826, 2839, 2876, 2879, 2896, 2916, 2937, 3038, 3058, 3184, 3200, 3201, 3249, 3267, 3306, 3336, 3346, 3352, 3368, 3411, 3443, 3461, 3476, 3544, 3570, 3602, 3621, 3691, 3704, 3723, 3781, 505, 507, 515, 517, 588, 641, 652, 721, 732, 741, 745, 752, 787, 798, 813, 896, 902, 954, 958, 974, 1006, 1021, 1038, 1047, 1062, 1093, 1109, 1165, 1174, 1190, 1277, 1302, 1322, 1329, 1330, 1332, 1333, 1335, 1337, 1361, 1365, 1379, 1383, 1387, 1389, 1467, 1569, 1719, 1773, 1783, 1793, 1817, 1827, 1837, 1991, 2031, 2038, 2054, 2071, 3870, 3885, 3921, 3925, 3943, 3952, 4008, 4016, 4032, 4043, 4050, 4082, 4109, 4111, 4117, 4146, 4153, 4175, 4194, 4211, 4228, 4232, 4252, 4267, 4280, 4284, 4298, 4321, 4333, 4347, 4375, 4382, 4394, 4427, 4437, 4442, 4447, 3933, 3966, 3969, 3970, 4001, 4003, 4042, 4436, 4438, 4441, 4443, 4446]
57, 484, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 53, 54, 55, 56, 58, 59, 60, 61, 63, 64, 67, 68, 69, 72, 73, 74, 76, 77, 78, 79, 81, 82, 83, 84, 86, 87, 88, 91, 93, 94, 95, 96, 97, 98, 99, 100, 101, 102, 103, 104, 105, 106, 107, 108, 109, 112, 113, 115, 117, 118, 119, 120, 121, 124, 125, 126, 127, 128, 129, 130, 131, 132, 136, 138, 139, 144, 151, 153, 154, 157, 158, 160, 162, 173, 175, 177, 181, 183, 184, 185, 186, 187, 188, 189, 191, 192, 193, 195, 196, 197, 198, 199, 202, 205, 206, 209, 210, 211, 214, 215, 216, 219, 220, 221, 227, 230, 233, 236, 239, 240, 241, 244, 245, 246, 247, 250, 251, 252, 253, 256, 257, 258, 259, 262, 263, 264, 265, 268, 269, 270, 271, 274, 275, 276, 277, 280, 281, 282, 283, 286, 287, 288, 289, 292, 293, 294, 295, 298, 299, 300, 301, 304, 305, 306, 307, 310, 311, 312, 313, 316, 317, 318, 319, 322, 323, 324, 325, 328, 329, 330, 331, 333, 334, 335, 336, 337, 339, 340, 341,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

342, 346, 347, 348, 349, 351, 352, 353, 354, 355, 357, 358, 359, 360, 361, 362, 363, 364, 365, 366, 367, 368, 369, 370, 371, 372, 376, 378, 379, 380, 381, 382, 383, 384, 385, 386, 387, 388, 389, 390, 391, 392, 393, 394, 395, 396, 397, 398, 399, 400, 401, 408, 409, 410, 411, 412, 413, 414, 415, 416, 417, 418, 419, 420, 421, 422, 423, 424, 425, 426, 427, 428, 429, 430, 431, 438, 439, 440, 441, 442, 443, 444, 445, 446, 447, 448, 449, 450, 452, 454, 455, 456, 458, 460, 461, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2696, 2698, 2967, 2981, 3018, 3036, 3038, 3056, 3058, 3076, 3078, 3096, 3155, 3171, 3187, 3203, 3219, 3229, 3245, 3261, 3277, 3293, 3314, 3330, 3346, 3362, 3378, 3392, 3408, 3424, 3440, 3456, 3707, 3789, 821, 832, 1141, 1222, 1305, 1307, 1309, 1312, 1316, 1318, 1319, 1322, 1329, 1332, 1339, 1342, 1349, 1357, 1361, 1365, 1369, 1373, 1375, 1379, 1383, 1384, 1385, 1386, 1387, 1391, 1393, 1910, 1918, 1926, 1934, 1942, 1947, 1955, 1963, 1971, 1979, 4049, 4053, 4058, 4062, 4087, 4091, 4096, 4100, 4329, 4357, 4361, 4390, 4416, 4419, 3826, 3859, 3861, 3862, 3894, 3896, 3897, 3929, 3934, 3968, 3969, 3970, 4001, 4003, 4005, 4006, 4038, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4446, 4448, 4449, 4451, 4454]
58, 446, [1, 3, 6, 7, 8, 11, 12, 13, 16, 17, 18, 23, 25, 27, 28, 29, 30, 31, 32, 33, 34, 35, 36, 37, 38, 39, 40, 41, 42, 46, 48, 49, 50, 51, 52, 53, 56, 57, 58, 59, 60, 61, 62, 63, 67, 68, 74, 83, 84, 91, 94, 104, 106, 112, 113, 119, 128, 129, 136, 139, 149, 151, 157, 158, 160, 162, 164, 165, 166, 168, 169, 170, 171, 172, 173, 174, 175, 176, 181, 183, 184, 185, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 250, 251, 252, 255, 256, 257, 258, 259, 262, 263, 264, 265, 267, 268, 269, 270, 271, 272, 273, 274, 275, 276, 277, 280, 282, 284, 286, 287, 288, 289, 292, 294, 295, 296, 297, 298, 299, 300, 301, 302, 303, 304, 305, 306, 307, 316, 317, 318, 319, 324, 325, 326, 327, 328, 329, 330, 331, 332, 333, 334, 335, 336, 337, 346, 347, 348, 349, 354, 355, 356, 357, 358, 359, 360, 361, 362, 363, 364, 365, 366, 367, 376, 377, 378, 379, 384, 385, 386, 387, 388, 389, 390, 391, 392, 393, 394, 395, 396, 397, 406, 407, 408, 409, 414, 415, 416, 417, 418, 419, 420, 421, 422, 423, 424, 425, 426, 427, 431, 435, 436, 437, 438, 439, 443, 444, 445, 446, 447, 448, 449, 450, 452, 454, 455, 456, 460, 461, 462, 464, 466, 467, 468, 472, 473, 474, 476, 478, 479, 480, 483, 485, 486, 488, 489, 491, 492, 494, 2207, 2221, 2227, 2241, 2247, 2261, 2267, 2281, 2287, 2293, 2424, 2426, 2464, 2859, 2873, 2913, 3018, 3036, 3038, 3056, 3058, 3076, 3078, 3096, 3267, 3325, 3357, 3586, 3648, 3680, 3707, 3789, 641, 652, 659, 692, 701, 731, 742, 749, 782, 791, 1021, 1182, 1305, 1307, 1309, 1312, 1319, 1320, 1321, 1322, 1323, 1324, 1326, 1328, 1329, 1330, 1331, 1332, 1333, 1334, 1336, 1338, 1339, 1342, 1349, 1357, 1361, 1365, 1369, 1373, 1375, 1379, 1383, 1387, 1391, 1393, 1966, 1995, 2006, 2011, 2035, 2046, 2051, 2075, 2091, 3936, 3939, 3948, 3960, 3964, 3974, 3977, 3986, 3998, 4008, 4011, 4020, 4032, 4036, 4046, 4049, 4058, 4070, 4233, 4245, 4265, 4267, 4277, 4354, 4366, 4386, 4388, 4398, 3826, 3859, 3861, 3862, 3894, 3896, 3897, 3898, 3929, 3931, 3969, 4001, 4041, 4073, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]
59, 462, [1, 3, 7, 8, 11, 16, 17, 18, 23, 25, 27, 28, 31, 32, 33, 34, 36, 37, 38, 40, 41, 42, 46, 48, 49, 50, 51, 52, 54, 55, 58, 59, 60, 61, 62, 63, 64, 67, 68, 70, 72, 73, 82, 83, 85, 87, 91, 93, 94, 95, 99, 105, 106, 108, 109, 112, 113, 114, 117, 128, 132, 133, 138, 139, 140, 144, 150, 153, 154, 157, 158, 160, 162, 163, 166, 167, 168, 172, 173, 175, 176, 177, 181, 183, 184, 185, 186, 187, 188, 189, 190, 191, 193, 194, 195, 196, 197, 198, 199, 202, 205, 206, 211, 220, 221, 227, 230, 231, 233, 236, 239, 240, 241, 243, 244, 245, 246, 247, 249, 250, 251, 252, 253, 256, 257, 258, 261, 262, 263, 264, 265, 267, 268, 269, 270, 271, 272, 273, 274, 275, 276, 277, 278, 279, 280, 281, 282, 283, 286, 287, 288, 289, 292, 293, 294, 295, 296, 297, 298, 299, 300, 301, 302, 304, 305, 306, 307, 308, 310, 311, 312, 316, 318, 322, 323, 324, 325, 326, 328, 329, 330, 331, 334, 335, 336, 337, 340, 341, 348, 353, 354, 355, 358, 359, 360, 361, 364, 365, 366, 367, 370, 371, 378, 379, 383, 384, 385, 388, 389, 390, 391, 393, 394, 395, 396, 397, 399, 400, 401, 403, 407, 408, 409, 412, 413, 414, 415, 417, 418, 419, 420, 421, 422, 423, 424, 425, 426, 427, 428, 429, 430, 431, 432, 433, 436, 437, 438, 441, 442, 443, 444, 445, 446, 447, 448, 449, 450, 452, 454, 455, 456, 458, 460, 461, 462, 463, 466, 467, 468, 472, 473, 474, 476, 478, 479, 480, 483, 485, 486, 488, 489, 491, 492, 494, 2207, 2221, 2227, 2232, 2241, 2247, 2258, 2261, 2267, 2281, 2287, 2293, 2419, 2429, 2501, 2510, 2516, 2518, 2544, 2551, 2681, 2690, 2724, 2731, 2787, 2801, 2884, 2890, 3018, 3036, 3038, 3056, 3058, 3061, 3071, 3076, 3078, 3096, 3315, 3331, 3356, 3379, 3389, 3405, 3433, 3446, 3453, 3474, 3490, 3527, 3538, 3552, 3568, 3616, 3707, 3789, 731, 739, 742, 750, 1061, 1108, 1142, 1187, 1305, 1307, 1309, 1312, 1319, 1322, 1326, 1328, 1329, 1332, 1339, 1342, 1349, 1357, 1361, 1364, 1365, 1369, 1373, 1375, 1379, 1383, 1386, 1387, 1391, 1393, 1553, 1558, 1677, 1682, 1687, 1692, 1856, 1883, 1886, 1923, 1990, 1998, 2022, 2027, 2035, 2051, 2063, 2166, 2193, 3871, 3880, 4051, 4068, 4087, 4096, 4159, 4168, 4245, 4273, 4366, 4394, 3826, 3859, 3861, 3862, 3894, 3896, 3897, 3898, 3929, 3931, 3933, 3934, 3966, 3968, 3969, 4001, 4006, 4040, 4041, 4042, 4073, 4075, 4077, 4078, 4110, 4112, 4113, 4114, 4145, 4147, 4149, 4182, 4184, 4185, 4187, 4188, 4189, 4191, 4192, 4197, 4199, 4200, 4201, 4203, 4204, 4431, 4433, 4434, 4436, 4438, 4439, 4446, 4448, 4449, 4451, 4454]
60, 438, [1, 3, 7, 8, 11, 16, 17, 18, 23, 25, 31, 32, 33, 34, 36, 40, 41, 42, 49, 59, 67, 69, 79, 88, 91, 93, 94, 96, 97, 98, 100, 101, 103, 104, 106, 107, 108, 112, 113, 115, 117, 118, 121, 127, 128, 130, 131, 132, 136, 138, 139, 144, 151, 153, 154, 157, 158, 159, 162, 164, 173, 174, 177, 178, 181, 183, 184, 185, 187, 188, 189, 191, 195, 196, 197, 198, 199, 202, 205, 206, 211, 220, 221, 227, 230, 231, 233, 236, 239, 240, 241, 244, 245, 246, 250, 252, 253, 256, 257, 258, 262, 264, 265, 268, 269, 270, 271, 274, 275, 282, 283, 286, 287, 294, 295, 298, 299, 300, 301, 304, 305, 312, 313, 316, 317, 324, 325, 328, 329, 330, 331, 333, 334, 335, 341, 342, 343, 346, 347, 353, 354, 355, 357, 358, 359, 360, 361, 362, 364, 365, 366, 367, 370, 371, 372, 376, 378, 379, 382, 383, 384, 385, 386, 388, 389, 390, 391, 394, 395, 396, 397, 400, 401, 408, 409, 412, 413, 414, 415, 418, 419, 420, 421, 424, 425, 426, 427, 430, 431, 438, 439, 442, 443, 444, 445, 448, 449, 450, 454, 455, 456, 460, 461, 463, 467, 468, 472, 473, 474, 478, 479, 480, 483, 485, 486, 488, 489, 491, 492, 494, 2207, 2221, 2227, 2232, 2241, 2247, 2258, 2261, 2267, 2281, 2287, 2293, 2316, 2318, 2356, 2358, 2587, 2601, 2627, 2641, 2696, 2698, 2701, 2711, 2952, 2967, 2978, 2981, 3018, 3036, 3038, 3056, 3058, 3061, 3071, 3076, 3078, 3096, 3155, 3171, 3219, 3229, 3293, 3314, 3378, 3392, 3456, 3475, 3491, 3523, 3539, 3549, 3565, 3597, 3613, 3634, 3650, 3682, 3698, 3707, 3712, 3728, 3760, 3776, 3789, 591, 602, 607, 611, 622, 631, 642, 651, 659, 662, 781, 792, 821, 832, 973, 989, 1054, 1070, 1141, 1188, 1222, 1267, 1305, 1307, 1309, 1312, 1315, 1316, 1317, 1318, 1319, 1321, 1322, 1324, 1329, 1332, 1336, 1338, 1339, 1342, 1349, 1357, 1359, 1360, 1361, 1362, 1364, 1365, 1367, 1368, 1369, 1370, 1373, 1375, 1379, 1383, 1386, 1387, 1391, 1393, 1856, 1883, 1886, 1910, 1923, 1926, 1942, 1947, 1963, 1966, 1979, 2003, 2006, 2043, 2070, 2078, 2094, 2102, 2107, 2115, 2131, 2139, 2166, 2193, 3871, 3880, 3899, 3906, 3922, 3939, 3948, 3964, 4015, 4024, 4049, 4058, 4091, 4100, 4159, 4168, 4210, 4218, 4231, 4235, 4243, 4247, 4264, 4276, 4292, 4296, 4304, 4308, 3826, 3859, 3861, 3862, 3894, 3896, 3969, 3970, 4001, 4003, 4005, 4006, 4038, 4040, 4041, 4073, 4078, 4112, 4113, 4114, 4145, 4147, 4149, 4182, 4184, 4185, 4187, 4188, 4201, 4203, 4204, 4431, 4433, 4434, 4436, 4438, 4439, 4446, 4448, 4449, 4451, 4454]
61, 348, [1, 3, 6, 7, 8, 12, 28, 30, 32, 33, 34, 35, 36, 37, 38, 39, 40, 41, 42, 46, 48, 50, 51, 52, 53, 54, 56, 57, 58, 59, 60, 62, 64, 68, 70, 72, 82, 95, 97, 99, 111, 112, 113, 115, 117, 123, 125, 127, 144, 151, 153, 154, 157, 162, 164, 165, 166, 167, 168, 169, 170, 171, 172, 174, 175, 176, 177, 179, 181, 183, 186, 187, 188, 191, 192, 193, 227, 230, 233, 236, 251, 252, 256, 257, 258, 259, 261, 262, 263, 264, 268, 269, 270, 274, 276, 277, 278, 279, 280, 281, 282, 283, 284, 285, 286, 287, 288, 290, 292, 293, 299, 305, 306, 308, 310, 311, 318, 320, 322, 323, 336, 341, 342, 347, 354, 359, 360, 365, 366, 371, 378, 383, 396, 397, 399, 401, 402, 403, 405, 407, 413, 414, 419, 426, 428, 430, 431, 437, 438, 439, 440, 441, 442, 443, 449, 450, 456, 457, 458, 460, 462, 463, 464, 466, 468, 470, 472, 488, 491, 2207, 2221, 2227, 2241, 2247, 2261, 2386, 2404, 2426, 2483, 2645, 2807, 2826, 2838, 2859, 2899, 2926, 2944, 2946, 2964, 2966, 2984, 2986, 3004, 3061, 3071, 3081, 3091, 3097, 3130, 3162, 3275, 3290, 3324, 3332, 3356, 3364, 3406, 3414, 3422, 3430, 3454, 3462, 3481, 3489, 3513, 3521, 3567, 3575, 3583, 3591, 3615, 3623, 3707, 3720, 3731, 3747, 3756, 3763, 3801, 3809, 3817, 3822, 661, 696, 700, 704, 705, 709, 713, 751, 755, 759, 786, 788, 813,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

887, 917, 975, 1005, 1039, 1047, 1112, 1166, 1249, 1305, 1312, 1315, 1320, 1329, 1330, 1331, 1337, 1342, 1345, 1357, 1361, 1365, 1367, 1382, 1383, 1386, 1387, 1390, 1391, 1812, 1819, 1822, 1829, 1832, 1839, 1993, 1997, 2001, 2005, 2017, 2021, 2028, 2032, 2036, 2040, 2052, 2056, 3851, 3855, 3865, 3868, 3930, 3932, 3943, 3947, 3950, 3954, 3959, 3963, 4044, 4047, 4059, 4062, 4063, 4082, 4141, 4212, 4227, 4254, 4267, 4271, 4279, 4283, 4307, 4348, 4364, 4368, 4388, 4392, 4400, 4404, 4425, 4428, 4435, 4437, 3826, 3894, 3896, 3898, 3934, 4075, 4110, 4114, 4185, 4187, 4188, 4189, 4191, 4192, 4193, 4195, 4196, 4199]

62, 281, [6, 7, 11, 12, 28, 29, 30, 31, 33, 34, 35, 36, 39, 41, 46, 48, 50, 51, 52, 53, 56, 57, 58, 62, 63, 83, 84, 87, 88, 91, 94, 99, 128, 129, 132, 133, 136, 139, 144, 164, 165, 166, 168, 169, 170, 171, 173, 174, 175, 176, 185, 186, 187, 188, 190, 191, 192, 193, 195, 197, 198, 210, 214, 215, 232, 235, 246, 252, 258, 259, 261, 275, 276, 277, 278, 280, 281, 282, 286, 288, 292, 294, 318, 319, 322, 323, 324, 325, 328, 329, 330, 331, 335, 336, 337, 340, 341, 378, 379, 383, 384, 385, 388, 389, 390, 394, 395, 396, 397, 400, 401, 438, 439, 441, 444, 447, 448, 456, 458, 459, 460, 462, 465, 466, 468, 471, 472, 474, 483, 486, 489, 2227, 2240, 2247, 2260, 2267, 2359, 2387, 2401, 2421, 2426, 2446, 2551, 2563, 2758, 2839, 2859, 2916, 2937, 3038, 3049, 3058, 3069, 3089, 3117, 3176, 3192, 3208, 3235, 3251, 3301, 3357, 3373, 3398, 3527, 3547, 3554, 3570, 3680, 3687, 3691, 3696, 3723, 3781, 3797, 3805, 3813, 498, 527, 582, 626, 652, 660, 742, 750, 813, 896, 902, 962, 1011, 1021, 1029, 1037, 1041, 1182, 1190, 1198, 1248, 1252, 1277, 1281, 1302, 1315, 1322, 1324, 1332, 1334, 1336, 1361, 1365, 1369, 1379, 1383, 1387, 1389, 1449, 1459, 1469, 1479, 1513, 1523, 1582, 1658, 1664, 1719, 1729, 1739, 1773, 1783, 1793, 1987, 1995, 2051, 2059, 2067, 2075, 3853, 3863, 3866, 3895, 3930, 3977, 4049, 4082, 4117, 4146, 4153, 4175, 4202, 4221, 4224, 4226, 4239, 4245, 4261, 4265, 4267, 4271, 4360, 4366, 4372, 4382, 4386, 4388, 4392, 3898, 3969, 4041, 4110, 4112, 4189, 4192, 4193, 4196, 4197, 4200, 4436, 4438, 4441, 4443, 4446]

63, 460, [1, 3, 6, 7, 8, 11, 12, 13, 16, 17, 18, 23, 25, 27, 29, 30, 31, 32, 34, 35, 36, 37, 39, 40, 41, 42, 48, 49, 52, 53, 54, 57, 58, 59, 62, 63, 64, 67, 70, 72, 75, 76, 77, 80, 81, 82, 85, 86, 87, 93, 94, 97, 98, 99, 102, 103, 104, 107, 108, 109, 112, 115, 117, 120, 121, 122, 124, 125, 126, 127, 130, 131, 132, 138, 139, 142, 143, 144, 147, 148, 149, 152, 153, 154, 157, 160, 162, 165, 166, 167, 170, 171, 172, 175, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 246, 249, 250, 251, 252, 255, 256, 257, 258, 261, 262, 263, 264, 265, 267, 268, 269, 270, 271, 272, 273, 274, 275, 279, 280, 281, 285, 286, 287, 291, 292, 293, 294, 295, 296, 297, 298, 299, 300, 301, 302, 303, 304, 305, 309, 310, 311, 315, 316, 317, 321, 322, 323, 324, 325, 326, 327, 328, 329, 330, 331, 332, 333, 334, 335, 339, 340, 341, 345, 346, 347, 351, 352, 353, 354, 355, 356, 357, 358, 359, 360, 361, 362, 363, 364, 365, 369, 370, 371, 372, 374, 375, 376, 377, 381, 382, 383, 384, 385, 386, 387, 388, 389, 390, 391, 392, 393, 394, 395, 399, 400, 401, 405, 406, 407, 411, 412, 413, 414, 415, 416, 417, 418, 419, 420, 421, 422, 423, 424, 425, 429, 430, 431, 435, 436, 437, 441, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2227, 2241, 2247, 2261, 2267, 2281, 2287, 2293, 2318, 2338, 2358, 2607, 2947, 2967, 2987, 3018, 3036, 3038, 3056, 3058, 3076, 3078, 3096, 3246, 3262, 3278, 3419, 3423, 3582, 3707, 3727, 3743, 3759, 3789, 631, 662, 688, 697, 721, 732, 752, 811, 842, 973, 981, 989, 1062, 1141, 1214, 1222, 1230, 1305, 1307, 1309, 1312, 1315, 1317, 1319, 1322, 1325, 1327, 1329, 1332, 1335, 1337, 1339, 1342, 1349, 1357, 1361, 1365, 1369, 1373, 1375, 1379, 1383, 1387, 1391, 1393, 1956, 1964, 1972, 1996, 2012, 2036, 2052, 2076, 2092, 2116, 2124, 2132, 3899, 3922, 3971, 3994, 4043, 4066, 3826, 3859, 3861, 3862, 3894, 3896, 3898, 3931, 3933, 3934, 3966, 3968, 3970, 4003, 4005, 4006, 4038, 4040, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

64, 480, [1, 3, 6, 7, 8, 11, 12, 13, 16, 17, 18, 23, 25, 27, 29, 30, 31, 32, 34, 35, 36, 37, 39, 40, 41, 42, 48, 49, 52, 53, 54, 57, 58, 59, 62, 63, 64, 67, 70, 72, 75, 76, 77, 79, 80, 81, 82, 85, 86, 87, 93, 94, 97, 98, 99, 102, 103, 104, 107, 108, 109, 112, 115, 117, 120, 121, 122, 125, 126, 127, 130, 131, 132, 138, 139, 141, 142, 143, 144, 146, 147, 148, 149, 152, 153, 154, 157, 160, 162, 165, 166, 167, 170, 171, 172, 175, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 246, 249, 250, 251, 252, 255, 256, 257, 258, 261, 262, 263, 264, 265, 267, 268, 269, 270, 271, 272, 273, 274, 275, 279, 280, 281, 285, 286, 287, 291, 292, 293, 294, 295, 296, 297, 298, 299, 300, 301, 302, 303, 304, 305, 309, 310, 311, 315, 316, 317, 319, 321, 322, 323, 324, 325, 326, 327, 328, 329, 330, 331, 332, 333, 334, 335, 339, 340, 341, 345, 346, 347, 348, 349, 350, 351, 352, 353, 354, 355, 356, 357, 358, 359, 360, 361, 362, 363, 364, 365, 369, 370, 371, 375, 376, 377, 378, 380, 381, 382, 383, 384, 385, 386, 387, 388, 389, 390, 391, 392, 393, 394, 395, 399, 400, 401, 405, 406, 407, 408, 410, 411, 412, 413, 414, 415, 416, 417, 418, 419, 420, 421, 422, 423, 424, 425, 429, 430, 431, 435, 436, 437, 441, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2227, 2241, 2247, 2261, 2267, 2281, 2287, 2293, 2318, 2338, 2358, 2499, 2947, 2967, 2987, 3018, 3036, 3038, 3056, 3058, 3076, 3078, 3096, 3246, 3262, 3278, 3343, 3359, 3422, 3515, 3583, 3662, 3678, 3707, 3727, 3743, 3759, 3789, 631, 643, 662, 664, 685, 687, 698, 706, 721, 731, 733, 742, 752, 754, 796, 811, 842, 973, 981, 989, 1022, 1030, 1061, 1142, 1181, 1189, 1214, 1222, 1230, 1305, 1307, 1309, 1312, 1315, 1317, 1319, 1322, 1325, 1327, 1329, 1332, 1335, 1337, 1339, 1342, 1349, 1357, 1361, 1365, 1369, 1373, 1375, 1379, 1383, 1387, 1391, 1393, 1552, 1686, 1956, 1996, 2036, 2044, 2076, 2116, 3899, 3922, 3971, 3994, 4043, 4066, 3826, 3859, 3861, 3862, 3894, 3896, 3898, 3931, 3933, 3934, 3966, 3968, 3970, 4003, 4005, 4006, 4038, 4040, 4042, 4075, 4077, 4078, 4110, 4112, 4113, 4114, 4145, 4147, 4149, 4182, 4184, 4185, 4187, 4188, 4189, 4191, 4192, 4193, 4195, 4196, 4197, 4199, 4200, 4201, 4203, 4204, 4431, 4433, 4434, 4436, 4438, 4439, 4441, 4443, 4444, 4446, 4448, 4449, 4451, 4454]

65, 470, [1, 3, 6, 7, 8, 11, 12, 13, 16, 17, 18, 27, 31, 32, 36, 37, 41, 42, 48, 49, 53, 54, 57, 58, 59, 63, 64, 67, 72, 75, 76, 77, 79, 80, 81, 82, 86, 87, 93, 94, 98, 99, 100, 102, 103, 104, 108, 109, 112, 117, 120, 121, 122, 124, 125, 126, 127, 131, 132, 138, 139, 143, 144, 147, 148, 149, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 280, 281, 285, 286, 287, 291, 292, 293, 294, 295, 296, 297, 298, 299, 300, 301, 302, 303, 304, 305, 310, 311, 312, 313, 314, 315, 316, 317, 318, 319, 320, 321, 322, 323, 324, 325, 326, 327, 328, 329, 330, 331, 332, 333, 334, 335, 340, 341, 342, 343, 344, 345, 346, 347, 348, 349, 350, 351, 352, 353, 354, 355, 356, 357, 358, 359, 360, 361, 362, 363, 364, 365, 370, 371, 372, 374, 375, 376, 377, 378, 380, 381, 382, 383, 384, 385, 386, 387, 388, 389, 390, 391, 392, 393, 394, 395, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2427, 2786, 2947, 2967, 2987, 3018, 3036, 3038, 3056, 3058, 3076, 3078, 3096, 3119, 3127, 3135, 3186, 3202, 3274, 3515, 3587, 3603, 3650, 3666, 3682, 3707, 3789, 541, 572, 595, 631, 662, 685, 706, 721, 752, 796, 811, 842, 949, 953, 957, 976, 982, 984, 990, 992, 1031, 1181, 1189, 1214, 1222, 1230, 1232, 1305, 1307, 1309, 1310, 1312, 1313, 1315, 1317, 1319, 1320, 1322, 1323, 1325, 1327, 1329, 1330, 1332, 1333, 1335, 1337, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1878, 1918, 1958, 1998, 2038, 2078, 3864, 3888, 3899, 3908, 3922, 3923, 3936, 3942, 3957, 3960, 3971, 3980, 3994, 3995, 4008, 4014, 4029, 4032, 4043, 4052, 4066, 4067, 4080, 4104, 4238, 4387, 4411, 4416, 4421, 3826, 3859, 3862, 3896, 3898, 3931, 3934, 3968, 3970, 4003, 4006, 4040, 4042, 4075, 4078, 4112, 4113, 4114, 4145, 4147, 4149, 4182, 4184, 4185, 4187, 4188, 4201, 4203, 4204, 4431, 4433, 4434, 4436, 4439, 4441, 4444, 4446, 4449, 4451, 4454]

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

66, 501, [1, 3, 6, 7, 8, 11, 12, 13, 16, 17, 18, 27, 30, 31, 32, 33, 34, 35, 36, 37, 38, 39, 40, 41, 42, 46, 48, 49, 50, 51, 52, 53, 54, 55, 57, 58, 59, 63, 64, 67, 72, 75, 76, 77, 78, 79, 80, 81, 82, 83, 84, 85, 86, 87, 91, 93, 94, 95, 96, 97, 98, 99, 100, 102, 103, 104, 108, 109, 112, 117, 120, 121, 122, 123, 124, 125, 126, 127, 128, 129, 130, 131, 132, 136, 138, 139, 140, 141, 142, 143, 144, 145, 147, 148, 149, 153, 154, 157, 162, 165, 166, 167, 168, 169, 170, 171, 172, 173, 174, 175, 176, 177, 181, 183, 184, 185, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 250, 251, 252, 253, 255, 256, 257, 258, 259, 261, 262, 263, 264, 265, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 430, 431, 432, 433, 434, 435, 436, 437, 438, 439, 440, 441, 442, 443, 444, 445, 446, 447, 448, 449, 450, 452, 454, 455, 456, 458, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2281, 2287, 2293, 3018, 3036, 3038, 3056, 3058, 3076, 3078, 3096, 3650, 3707, 3789, 541, 616, 631, 706, 721, 796, 811, 976, 1214, 1305, 1307, 1309, 1310, 1312, 1317, 1319, 1320, 1322, 1327, 1329, 1330, 1332, 1337, 1339, 1340, 1342, 1349, 1357, 1361, 1365, 1369, 1370, 1373, 1375, 1379, 1383, 1387, 1391, 1393, 1426, 1878, 1958, 2038, 3864, 3870, 3922, 3923, 3936, 3942, 3994, 3995, 4008, 4014, 4066, 4067, 4080, 4086, 3826, 3859, 3862, 3894, 3896, 3897, 3898, 3931, 3934, 3966, 3968, 3969, 3970, 4003, 4006, 4038, 4040, 4041, 4042, 4075, 4078, 4110, 4112, 4113, 4114, 4145, 4147, 4149, 4182, 4184, 4185, 4187, 4188, 4189, 4191, 4192, 4193, 4195, 4196, 4197, 4199, 4201, 4203, 4204, 4431, 4433, 4434, 4436, 4438, 4439, 4441, 4443, 4444, 4446, 4448, 4449, 4451, 4454]

67, 470, [1, 3, 6, 7, 8, 11, 12, 13, 16, 17, 18, 27, 31, 32, 36, 37, 41, 42, 46, 48, 49, 51, 52, 53, 54, 57, 58, 59, 63, 64, 67, 72, 75, 76, 77, 79, 80, 81, 82, 84, 85, 86, 87, 93, 94, 98, 99, 103, 104, 108, 109, 112, 115, 117, 119, 120, 121, 122, 124, 125, 126, 127, 131, 132, 138, 139, 143, 144, 146, 147, 148, 149, 151, 152, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 279, 280, 281, 285, 286, 287, 291, 292, 293, 294, 295, 296, 297, 298, 299, 300, 301, 302, 303, 304, 305, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 369, 370, 371, 375, 376, 377, 381, 382, 383, 384, 385, 386, 387, 388, 389, 390, 391, 392, 393, 394, 395, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2407, 2427, 2498, 2518, 2538, 2659, 2679, 2699, 2786, 2806, 2947, 2967, 2987, 3018, 3036, 3038, 3056, 3058, 3076, 3078, 3096, 3119, 3127, 3135, 3186, 3202, 3274, 3347, 3363, 3426, 3442, 3515, 3587, 3603, 3650, 3666, 3682, 3707, 3789, 541, 572, 631, 643, 752, 754, 811, 842, 949, 953, 957, 976, 982, 984, 990, 992, 1031, 1061, 1069, 1096, 1102, 1104, 1110, 1112, 1151, 1181, 1189, 1214, 1216, 1222, 1224, 1230, 1232, 1305, 1307, 1309, 1310, 1312, 1313, 1317, 1319, 1320, 1322, 1325, 1327, 1329, 1332, 1333, 1335, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1878, 1958, 1998, 2078, 3864, 3888, 3922, 3923, 3936, 3971, 3994, 4032, 4043, 4052, 4080, 4104, 4232, 4238, 4322, 4328, 4411, 4416, 4421, 3826, 3859, 3862, 3896, 3897, 3898, 3931, 3934, 3966, 3968, 3970, 4003, 4005, 4006, 4040, 4042, 4073, 4075, 4078, 4112, 4113, 4114, 4145, 4147, 4149, 4182, 4184, 4185, 4187, 4188, 4201, 4203, 4204, 4431, 4433, 4434, 4436, 4439, 4441, 4444, 4446, 4449, 4451, 4454]

68, 472, [1, 3, 6, 7, 8, 11, 12, 13, 16, 17, 18, 27, 31, 32, 36, 37, 41, 42, 48, 49, 53, 54, 56, 57, 58, 59, 61, 62, 63, 64, 67, 68, 70, 72, 74, 75, 76, 77, 79, 80, 81, 82, 86, 87, 93, 94, 98, 99, 103, 104, 108, 109, 112, 115, 117, 119, 120, 121, 122, 124, 125, 126, 127, 131, 132, 138, 139, 143, 144, 146, 147, 148, 149, 151, 152, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 280, 281, 285, 286, 287, 291, 292, 293, 294, 295, 296, 297, 298, 299, 300, 301, 302, 303, 304, 305, 308, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 369, 370, 371, 375, 376, 377, 381, 382, 383, 384, 385, 386, 387, 388, 389, 390, 391, 392, 393, 394, 395, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2427, 2447, 2498, 2518, 2659, 2679, 2699, 2786, 2806, 2947, 2967, 2987, 3018, 3036, 3038, 3056, 3058, 3076, 3078, 3096, 3119, 3127, 3135, 3170, 3186, 3202, 3331, 3347, 3363, 3426, 3442, 3515, 3587, 3603, 3650, 3666, 3682, 3707, 3789, 541, 572, 595, 662, 664, 752, 754, 811, 842, 949, 953, 957, 974, 976, 982, 984, 990, 992, 1053, 1061, 1069, 1102, 1104, 1110, 1112, 1151, 1181, 1189, 1214, 1216, 1222, 1224, 1230, 1232, 1305, 1307, 1309, 1310, 1312, 1313, 1315, 1319, 1322, 1323, 1325, 1327, 1329, 1332, 1333, 1335, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1918, 1998, 2078, 3864, 3888, 3899, 3908, 3960, 3971, 3994, 4032, 4043, 4052, 4080, 4104, 4238, 4244, 4322, 4328, 4411, 4416, 4421, 3826, 3859, 3862, 3896, 3898, 3929, 3931, 3933, 3934, 3968, 3970, 4003, 4005, 4006, 4040, 4042, 4073, 4075, 4078, 4112, 4113, 4114, 4145, 4147, 4149, 4182, 4184, 4185, 4187, 4188, 4201, 4203, 4204, 4431, 4433, 4434, 4436, 4439, 4441, 4444, 4446, 4449, 4451, 4454]

69, 482, [1, 3, 6, 7, 8, 11, 12, 13, 16, 17, 18, 23, 25, 27, 28, 29, 30, 31, 32, 34, 35, 36, 37, 41, 42, 48, 49, 53, 54, 55, 56, 57, 58, 59, 60, 61, 62, 63, 64, 67, 68, 70, 72, 74, 75, 76, 77, 79, 80, 81, 82, 86, 87, 93, 94, 98, 99, 103, 104, 108, 109, 112, 117, 120, 121, 122, 124, 125, 126, 127, 131, 132, 138, 139, 143, 144, 145, 147, 148, 149, 153, 154, 157, 162, 165, 166, 167, 169, 170, 171, 172, 176, 177, 181, 183, 184, 186, 187, 188, 189, 190, 191, 192, 193, 194, 195, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 271, 272, 273, 274, 275, 280, 281, 282, 284, 285, 286, 287, 288, 290, 291, 292, 293, 294, 295, 296, 297, 298, 299, 300, 301, 302, 303, 304, 305, 306, 308, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 370, 371, 375, 376, 377, 381, 382, 383, 384, 385, 386, 387, 388, 389, 390, 391, 392, 393, 394, 395, 400, 401, 402, 403, 404, 405, 406, 407, 408, 409, 410, 411, 412, 413, 414, 415, 416, 417, 418, 419, 420, 421, 422, 423, 424, 425, 430, 431, 432, 433, 434, 435, 436, 437, 438, 439, 440, 441, 442, 443, 444, 445, 446, 447, 448, 449, 450, 452, 454, 455, 460, 461, 462, 464, 466, 467, 468, 470, 472, 473, 474, 476, 478, 479, 480, 483, 485, 486, 488, 489, 491, 492, 494, 2207, 2221, 2227, 2241, 2247, 2261, 2267, 2281, 2287, 2293, 2498, 2518, 2679, 2699, 2947, 3018, 3036, 3038, 3056, 3058, 3076, 3078, 3096, 3119, 3331, 3347, 3363, 3426, 3442, 3650, 3707, 3789, 572, 595, 662, 664, 721, 733, 752, 754, 775, 796, 811, 842, 949, 1053, 1061, 1069, 1102, 1110, 1214, 1305, 1307, 1309, 1312, 1313, 1315, 1319, 1322, 1323, 1325, 1327, 1329, 1330, 1332, 1333, 1335, 1337, 1339, 1340, 1342, 1343, 1349, 1357, 1359, 1360, 1361, 1365, 1369, 1373, 1375, 1379, 1383, 1387, 1389, 1391, 1393, 1918, 1998, 2038, 2078, 3885, 3888, 3899, 3908, 3960, 3971, 3994, 4008, 4032, 4043, 4052, 4066, 4067, 4080, 4086, 4101, 4104, 4297, 4303, 4328, 4334, 4411, 3826, 3859, 3861, 3862, 3896, 3898, 3929, 3931, 3933, 3934, 3968, 3970, 4003, 4006, 4040, 4042, 4075, 4078, 4112, 4113, 4114, 4145, 4147, 4149, 4182, 4184,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

4185, 4187, 4188, 4192, 4193, 4195, 4196, 4197, 4199, 4200, 4201, 4203, 4204, 4431, 4433, 4434, 4436, 4438, 4439, 4441, 4443, 4444, 4446, 4449, 4451, 4454]
70, 471, [1, 3, 6, 7, 8, 11, 12, 13, 16, 17, 18, 27, 31, 32, 36, 37, 41, 42, 48, 49, 53, 54, 57, 58, 59, 63, 64, 67, 70, 72, 74, 75, 76, 77, 79, 80, 81, 82, 86, 87, 93, 94, 98, 99, 103, 104, 108, 109, 112, 117, 120, 121, 122, 124, 125, 126, 127, 128, 129, 130, 131, 132, 136, 138, 139, 141, 142, 143, 144, 147, 148, 149, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 280, 281, 285, 286, 287, 291, 292, 293, 294, 295, 296, 297, 298, 299, 300, 301, 302, 303, 304, 305, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 370, 371, 375, 376, 377, 381, 382, 383, 384, 385, 386, 387, 388, 389, 390, 391, 392, 393, 394, 395, 396, 398, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2427, 2479, 2498, 2518, 2679, 2699, 2766, 2786, 2947, 2967, 2987, 3018, 3036, 3038, 3056, 3058, 3076, 3078, 3096, 3119, 3127, 3135, 3186, 3202, 3274, 3331, 3347, 3363, 3410, 3426, 3442, 3571, 3587, 3603, 3650, 3666, 3682, 3707, 3789, 541, 572, 595, 662, 664, 721, 733, 796, 811, 842, 949, 953, 957, 976, 982, 984, 990, 992, 1031, 1053, 1055, 1061, 1069, 1094, 1102, 1104, 1110, 1112, 1173, 1181, 1189, 1214, 1222, 1224, 1230, 1232, 1305, 1307, 1309, 1310, 1312, 1313, 1315, 1317, 1319, 1322, 1323, 1325, 1327, 1329, 1330, 1332, 1337, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1878, 1918, 2038, 3864, 3888, 3899, 3908, 3922, 3923, 3960, 3971, 3994, 4008, 4066, 4067, 4080, 4104, 4238, 4328, 4334, 4411, 4416, 4421, 3826, 3859, 3862, 3896, 3898, 3931, 3933, 3934, 3968, 3970, 4003, 4006, 4038, 4040, 4041, 4042, 4075, 4078, 4112, 4113, 4114, 4145, 4147, 4149, 4182, 4184, 4185, 4187, 4188, 4201, 4203, 4204, 4431, 4433, 4434, 4436, 4439, 4441, 4444, 4446, 4449, 4451, 4454]
71, 469, [[1, 3, 6, 7, 8, 11, 12, 13, 16, 17, 18, 27, 31, 32, 36, 37, 41, 42, 48, 49, 53, 54, 57, 58, 59, 63, 64, 67, 72, 75, 76, 77, 79, 80, 81, 82, 86, 87, 93, 94, 98, 99, 103, 104, 108, 109, 112, 117, 120, 121, 122, 124, 125, 126, 127, 128, 129, 130, 131, 132, 136, 138, 139, 141, 142, 143, 144, 147, 148, 149, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 280, 281, 285, 286, 287, 291, 292, 293, 294, 295, 296, 297, 298, 299, 300, 301, 302, 303, 304, 305, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 370, 371, 375, 376, 377, 381, 382, 383, 384, 385, 386, 387, 388, 389, 390, 391, 392, 393, 394, 395, 396, 398, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2427, 2498, 2518, 2679, 2699, 2766, 2786, 2947, 2967, 2987, 3018, 3036, 3038, 3056, 3058, 3076, 3078, 3096, 3119, 3127, 3135, 3186, 3202, 3274, 3347, 3410, 3426, 3442, 3571, 3587, 3603, 3650, 3666, 3682, 3707, 3789, 541, 572, 595, 631, 643, 662, 664, 721, 733, 796, 811, 842, 949, 953, 957, 976, 982, 984, 990, 992, 1031, 1061, 1069, 1094, 1102, 1104, 1110, 1112, 1173, 1181, 1189, 1214, 1222, 1224, 1230, 1232, 1305, 1307, 1309, 1310, 1312, 1313, 1315, 1317, 1319, 1320, 1322, 1323, 1325, 1327, 1329, 1330, 1332, 1337, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1878, 1918, 1958, 2038, 3864, 3888, 3899, 3908, 3922, 3923, 3936, 3960, 3971, 3994, 4008, 4066, 4067, 4080, 4104, 4238, 4328, 4334, 4411, 4416, 4421, 3826, 3859, 3862, 3896, 3898, 3931, 3934, 3968, 3970, 4003, 4006, 4038, 4040, 4041, 4042, 4075, 4078, 4112, 4113, 4114, 4145, 4147, 4149, 4182, 4184, 4185, 4187, 4188, 4201, 4203, 4204, 4431, 4433, 4434, 4436, 4439, 4441, 4444, 4446, 4449, 4451, 4454]
72, 488, [1, 3, 6, 7, 8, 11, 12, 13, 16, 17, 18, 23, 25, 27, 28, 29, 30, 31, 32, 34, 35, 36, 37, 41, 42, 48, 49, 53, 54, 55, 56, 57, 58, 59, 60, 61, 62, 63, 64, 67, 68, 70, 72, 73, 74, 75, 76, 77, 79, 80, 81, 82, 86, 87, 93, 94, 98, 99, 100, 101, 102, 103, 104, 105, 106, 107, 108, 109, 112, 113, 115, 117, 118, 119, 120, 121, 122, 124, 125, 126, 127, 131, 132, 138, 139, 143, 144, 146, 147, 148, 149, 151, 152, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 246, 247, 249, 250, 251, 252, 253, 255, 256, 257, 258, 259, 261, 262, 263, 264, 265, 267, 268, 269, 270, 271, 272, 273, 274, 275, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 340, 341, 342, 343, 344, 345, 346, 347, 348, 349, 350, 351, 352, 353, 354, 355, 356, 357, 358, 359, 360, 361, 362, 363, 364, 365, 366, 368, 369, 370, 371, 372, 374, 375, 376, 377, 378, 380, 381, 382, 383, 384, 385, 386, 387, 388, 389, 390, 391, 392, 393, 394, 395, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2227, 2241, 2247, 2261, 2267, 2281, 2287, 2293, 2786, 2806, 2947, 2967, 2987, 3018, 3036, 3038, 3056, 3058, 3076, 3078, 3096, 3119, 3515, 3587, 3603, 3650, 3666, 3682, 3707, 3789, 572, 595, 662, 685, 752, 811, 842, 949, 1181, 1189, 1214, 1222, 1230, 1232, 1305, 1307, 1309, 1312, 1313, 1315, 1319, 1322, 1323, 1325, 1329, 1332, 1333, 1335, 1339, 1340, 1342, 1343, 1349, 1357, 1359, 1360, 1361, 1365, 1369, 1373, 1375, 1379, 1381, 1383, 1385, 1387, 1389, 1391, 1393, 1918, 1998, 2078, 3885, 3888, 3899, 3908, 3957, 3960, 3971, 3980, 4029, 4032, 4043, 4052, 4080, 4104, 4381, 4387, 4411, 4416, 4421, 3826, 3859, 3861, 3862, 3896, 3898, 3929, 3931, 3933, 3934, 3968, 3970, 4001, 4003, 4005, 4006, 4040, 4042, 4073, 4075, 4078, 4112, 4113, 4114, 4145, 4147, 4149, 4182, 4184, 4185, 4187, 4188, 4192, 4193, 4195, 4196, 4197, 4199, 4200, 4201, 4203, 4204, 4431, 4433, 4434, 4436, 4439, 4441, 4444, 4446, 4449, 4451, 4454]
73, 464, [1, 3, 6, 7, 8, 11, 12, 13, 16, 17, 18, 27, 31, 32, 36, 37, 41, 42, 48, 49, 53, 54, 57, 58, 59, 63, 64, 67, 72, 75, 76, 77, 79, 80, 81, 82, 86, 87, 93, 94, 98, 99, 103, 104, 108, 109, 112, 117, 120, 121, 122, 124, 125, 126, 127, 131, 132, 138, 139, 143, 144, 147, 148, 149, 153, 154, 157, 162, 166, 167, 171, 172, 176, 177, 181, 183, 184, 186, 187, 188, 189, 191, 192, 193, 194, 196, 197, 198, 199, 202, 205, 206, 209, 210, 211, 214, 215, 216, 219, 220, 221, 227, 230, 233, 236, 239, 240, 241, 243, 244, 245, 250, 251, 256, 257, 262, 263, 264, 265, 267, 268, 269, 270, 271, 272, 273, 274, 275, 280, 281, 285, 286, 287, 291, 292, 293, 294, 295, 296, 297, 298, 299, 300, 301, 302, 303, 304, 305, 310, 311, 312, 314, 316, 317, 318, 320, 322, 323, 324, 325, 326, 327, 328, 329, 330, 331, 332, 333, 334, 335, 340, 341, 346, 347, 352, 353, 354, 355, 356, 357, 358, 359, 360, 361, 362, 363, 364, 365, 370, 371, 375, 376, 377, 381, 382, 383, 384, 385, 386, 387, 388, 389, 390, 391, 392, 393, 394, 395, 400, 401, 402, 404, 406, 407, 408, 410, 412, 413, 414, 415, 416, 417, 418, 419, 420, 421, 422, 423, 424, 425, 430, 431, 436, 437, 442, 443, 444, 445, 446, 447, 448, 449, 450, 452, 454, 455, 460, 461, 466, 467, 472, 473, 474, 476, 478, 479, 480, 483, 485, 486, 488, 489, 491, 492, 494, 2207, 2221, 2241, 2261, 2281, 2287, 2293, 2427, 2498, 2518, 2679, 2699, 2786, 2947, 2967, 2987, 3018, 3036, 3038, 3056, 3058, 3076, 3078, 3096, 3119, 3127, 3135, 3186, 3202, 3274, 3347, 3363, 3426, 3442, 3515, 3587, 3603, 3650, 3666, 3682, 3707, 3789, 541, 572, 595, 631, 643, 662, 664, 721, 733, 752, 754, 796, 811, 842, 949, 953, 957, 976, 982, 984, 990, 992, 1031, 1061, 1069, 1102, 1104, 1110, 1112, 1151, 1181, 1189, 1214, 1222, 1224, 1230, 1232, 1305, 1307, 1309, 1310, 1312, 1313, 1315, 1317, 1319, 1320, 1322, 1323, 1325, 1327, 1329, 1330, 1332, 1333, 1335, 1337, 1339, 1340, 1342, 1343, 1349, 1357, 1359, 1360, 1361, 1362, 1363, 1364, 1365, 1366, 1367, 1368, 1369, 1370, 1373, 1375, 1379, 1381, 1383, 1385, 1387, 1389, 1391, 1393, 1406, 1416, 1426, 1878, 1918, 1958, 1998, 2038,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

2078, 3864, 3888, 3899, 3908, 3922, 3923, 3936, 3960, 3971, 3994, 4008, 4032, 4043, 4052, 4066, 4067, 4080, 4104, 4238, 4328, 4411,
4416, 4421, 3826, 3859, 3862, 3896, 3898, 3931, 3934, 3968, 3970, 4003, 4006, 4040, 4042, 4075, 4078, 4112, 4113, 4114, 4145, 4147,
4149, 4182, 4184, 4185, 4187, 4188, 4201, 4203, 4204, 4431, 4433, 4434, 4436, 4439, 4441, 4444, 4446, 4449, 4451, 4454]
74, 466, [1, 3, 6, 7, 8, 11, 12, 13, 16, 17, 18, 27, 31, 32, 36, 37, 41, 42, 48, 49, 53, 54, 57, 58, 59, 63, 64, 67, 70, 72, 74, 75, 76, 77, 79, 80, 81,
82, 86, 87, 93, 94, 98, 99, 103, 104, 108, 109, 112, 117, 120, 121, 122, 124, 125, 126, 127, 131, 132, 138, 139, 143, 144, 147, 148, 149, 153,
154, 157, 162, 166, 167, 171, 172, 176, 177, 181, 183, 184, 186, 187, 188, 189, 191, 192, 193, 194, 196, 197, 198, 199, 202, 205, 206, 209,
210, 211, 214, 215, 216, 219, 220, 221, 227, 230, 233, 236, 239, 240, 241, 243, 244, 245, 250, 251, 256, 257, 262, 263, 264, 265, 267, 268,
269, 270, 271, 272, 273, 274, 275, 280, 281, 285, 286, 287, 291, 292, 293, 294, 295, 296, 297, 298, 299, 300, 301, 302, 303, 304, 305, 310,
311, 312, 314, 316, 317, 318, 320, 322, 323, 324, 325, 326, 327, 328, 329, 330, 331, 332, 333, 334, 335, 340, 341, 346, 347, 352, 353, 354,
355, 356, 357, 358, 359, 360, 361, 362, 363, 364, 365, 370, 371, 375, 376, 377, 381, 382, 383, 384, 385, 386, 387, 388, 389, 390, 391, 392,
393, 394, 395, 400, 401, 402, 404, 406, 407, 408, 410, 412, 413, 414, 415, 416, 417, 418, 419, 420, 421, 422, 423, 424, 425, 430, 431, 436,
437, 442, 443, 444, 445, 446, 447, 448, 449, 450, 452, 454, 455, 460, 461, 466, 467, 472, 473, 474, 476, 478, 479, 480, 483, 485, 486, 488,
489, 491, 492, 494, 2207, 2221, 2241, 2261, 2281, 2287, 2293, 2427, 2479, 2498, 2518, 2679, 2699, 2786, 2947, 2967, 2987, 3018, 3036,
3038, 3056, 3058, 3076, 3078, 3096, 3119, 3127, 3135, 3186, 3202, 3274, 3331, 3347, 3363, 3426, 3442, 3515, 3587, 3603, 3650, 3666,
3682, 3707, 3789, 541, 572, 595, 662, 664, 721, 733, 752, 754, 796, 811, 842, 949, 953, 957, 976, 982, 984, 990, 992, 1031, 1053, 1055,
1061, 1069, 1102, 1104, 1110, 1112, 1151, 1181, 1189, 1214, 1222, 1224, 1230, 1232, 1305, 1307, 1309, 1310, 1312, 1313, 1315, 1317,
1319, 1322, 1323, 1325, 1327, 1329, 1330, 1332, 1333, 1335, 1337, 1339, 1340, 1342, 1343, 1349, 1357, 1359, 1360, 1361, 1362, 1363,
1364, 1365, 1366, 1367, 1368, 1369, 1370, 1373, 1375, 1379, 1381, 1383, 1385, 1387, 1389, 1391, 1393, 1406, 1416, 1426, 1878, 1918,
1998, 2038, 2078, 3864, 3888, 3899, 3908, 3922, 3923, 3960, 3971, 3994, 4008, 4032, 4043, 4052, 4066, 4067, 4080, 4104, 4238, 4328,
4411, 4416, 4421, 3826, 3859, 3862, 3896, 3898, 3931, 3933, 3934, 3968, 3970, 4003, 4006, 4040, 4042, 4075, 4078, 4112, 4113, 4114,
4145, 4147, 4149, 4182, 4184, 4185, 4187, 4188, 4201, 4203, 4204, 4431, 4433, 4434, 4436, 4439, 4441, 4444, 4446, 4449, 4451, 4454]
75, 441, [1, 3, 7, 8, 11, 12, 13, 17, 18, 25, 27, 28, 29, 30, 31, 32, 34, 35, 36, 37, 39, 40, 41, 42, 46, 48, 49, 52, 53, 54, 57, 58, 59, 61, 62, 63,
64, 67, 70, 72, 74, 75, 76, 77, 80, 81, 82, 84, 85, 86, 87, 91, 93, 94, 97, 98, 99, 102, 103, 104, 106, 107, 108, 109, 112, 115, 117, 119, 120,
121, 122, 125, 126, 127, 129, 130, 131, 132, 136, 138, 139, 141, 142, 143, 144, 146, 147, 148, 149, 150, 151, 152, 153, 154, 157, 160, 162,
164, 165, 166, 167, 169, 170, 171, 172, 175, 176, 177, 183, 184, 187, 188, 189, 192, 193, 194, 197, 198, 199, 202, 206, 211, 216, 221, 227,
230, 233, 236, 239, 243, 244, 245, 246, 247, 249, 250, 251, 252, 255, 256, 257, 259, 261, 262, 263, 264, 265, 267, 268, 269, 273, 274, 275,
276, 277, 278, 279, 280, 281, 285, 286, 287, 288, 289, 290, 291, 292, 293, 294, 295, 296, 297, 298, 299, 303, 304, 305, 306, 307, 308, 309,
310, 311, 315, 316, 317, 318, 319, 320, 321, 322, 323, 324, 325, 326, 327, 328, 329, 333, 334, 335, 336, 337, 338, 339, 340, 341, 345, 346,
347, 348, 349, 350, 351, 352, 353, 354, 355, 356, 357, 358, 359, 363, 364, 365, 366, 367, 368, 369, 370, 371, 375, 376, 377, 378, 379, 380,
381, 382, 383, 384, 385, 386, 387, 388, 389, 393, 394, 395, 396, 397, 398, 399, 400, 401, 405, 406, 407, 408, 409, 410, 411, 412, 413, 414,
416, 417, 418, 419, 423, 424, 425, 426, 428, 429, 430, 431, 432, 434, 435, 436, 437, 441, 442, 443, 444, 446, 447, 448, 449, 454, 455, 460,
461, 466, 467, 472, 473, 478, 479, 485, 488, 491, 494, 2215, 2221, 2241, 2247, 2261, 2267, 2241, 2291, 2293, 2766, 2787, 2858, 2898,
3026, 3036, 3046, 3056, 3066, 3076, 3086, 3096, 3114, 3199, 3262, 3579, 3583, 3678, 3715, 3726, 3742, 3758, 3789, 495, 508, 527, 585,
626, 641, 652, 675, 716, 731, 742, 765, 806, 812, 843, 852, 962, 981, 1142, 1197, 1213, 1221, 1237, 1306, 1308, 1310, 1313, 1320, 1323,
1330, 1333, 1340, 1343, 1350, 1357, 1359, 1362, 1365, 1369, 1374, 1376, 1380, 1384, 1388, 1392, 1394, 1462, 1868, 1908, 1948, 1964,
1988, 2004, 2028, 2044, 2068, 2108, 2148, 2180, 2186, 2190, 2194, 2198, 2202, 2863, 3893, 3905, 3914, 3935, 3965, 3977, 3986, 4007,
4037, 3862, 3896, 3898, 3931, 3934, 3968, 3970, 4003, 4006, 4040, 4042, 4075, 4078, 4112, 4114, 4147, 4184, 4187, 4188, 4191, 4193,
4195, 4196, 4197, 4199, 4200, 4203, 4434, 4439, 4444, 4449]
76, 430, [3, 6, 7, 8, 11, 12, 13, 17, 18, 25, 27, 28, 29, 30, 31, 32, 34, 35, 36, 37, 39, 40, 41, 42, 46, 48, 49, 52, 53, 54, 56, 57, 58, 59, 62, 63,
64, 67, 70, 72, 74, 75, 76, 77, 80, 81, 82, 85, 86, 87, 91, 93, 94, 95, 96, 97, 98, 99, 101, 102, 103, 104, 107, 108, 109, 112, 115, 117, 118,
119, 120, 121, 122, 124, 125, 126, 127, 129, 130, 131, 132, 138, 139, 142, 143, 144, 146, 147, 148, 149, 152, 153, 154, 157, 160, 162, 164,
165, 166, 167, 170, 171, 172, 175, 176, 177, 183, 184, 187, 188, 189, 191, 192, 193, 194, 197, 198, 199, 202, 206, 209, 210, 211, 216, 221,
227, 230, 233, 236, 239, 243, 244, 245, 246, 247, 249, 250, 251, 252, 253, 255, 256, 257, 258, 261, 262, 263, 265, 267, 268, 269, 273, 274,
275, 276, 277, 278, 279, 280, 281, 285, 286, 287, 288, 289, 290, 291, 292, 293, 297, 298, 299, 303, 304, 305, 306, 307, 308, 309, 310, 311,
312, 313, 314, 315, 316, 317, 321, 322, 323, 324, 326, 327, 328, 329, 333, 334, 335, 336, 338, 339, 340, 341, 343, 345, 346, 347, 348, 349,
350, 351, 352, 353, 357, 358, 359, 363, 364, 365, 366, 367, 368, 369, 370, 371, 372, 373, 374, 375, 376, 377, 378, 380, 381, 382, 383, 387,
388, 389, 393, 394, 395, 399, 400, 401, 405, 406, 407, 408, 409, 410, 411, 412, 413, 417, 418, 419, 423, 424, 425, 426, 427, 428, 429, 430,
431, 432, 433, 434, 435, 436, 437, 441, 442, 443, 447, 448, 449, 454, 455, 460, 461, 466, 467, 468, 470, 472, 473, 478, 479, 483, 485, 486,
488, 491, 494, 2215, 2221, 2227, 2241, 2247, 2261, 2267, 2281, 2291, 2293, 2338, 2359, 2607, 2698, 3026, 3036, 3038, 3056, 3066, 3076,
3086, 3096, 3215, 3262, 3371, 3403, 3423, 3534, 3566, 3582, 3715, 3789, 498, 527, 542, 582, 585, 596, 605, 632, 672, 722, 785, 812, 875,
902, 924, 989, 1070, 1149, 1306, 1308, 1310, 1313, 1320, 1323, 1330, 1333, 1340, 1343, 1350, 1358, 1361, 1365, 1369, 1374, 1376, 1379,
1383, 1388, 1392, 1394, 1868, 1908, 1940, 1948, 1972, 1988, 2020, 2028, 2068, 2108, 2132, 2140, 2148, 2156, 2164, 2180, 2186,
2198, 2202, 3921, 3949, 3958, 3993, 4065, 4093, 4137, 3862, 3896, 3898, 3931, 3934, 3968, 3970, 4003, 4006, 4040, 4042, 4075, 4078,
4112, 4114, 4147, 4184, 4187, 4189, 4191, 4192, 4193, 4195, 4196, 4197, 4199, 4200, 4203, 4434, 4436, 4438, 4439, 4441, 4444, 4449]
77, 426, [3, 6, 7, 8, 11, 12, 13, 17, 18, 25, 27, 28, 29, 30, 31, 32, 34, 35, 36, 37, 39, 40, 41, 42, 46, 48, 49, 52, 53, 54, 57, 58, 59, 61, 62, 63,
64, 67, 70, 72, 74, 75, 76, 77, 80, 81, 82, 85, 86, 87, 93, 94, 97, 98, 99, 102, 103, 104, 106, 107, 108, 109, 112, 115, 117, 119, 120, 121, 122,
125, 126, 127, 129, 130, 131, 132, 136, 138, 139, 140, 141, 142, 143, 144, 146, 147, 148, 150, 151, 152, 153, 154, 157, 160, 162, 164,
165, 166, 167, 169, 170, 171, 172, 174, 175, 176, 177, 183, 184, 187, 188, 189, 192, 193, 194, 197, 198, 199, 202, 206, 211, 216, 221, 227,
230, 233, 236, 239, 243, 244, 245, 246, 247, 249, 250, 251, 252, 255, 256, 257, 258, 259, 261, 262, 263, 267, 268, 269, 273, 274, 275, 276,
278, 279, 280, 281, 285, 286, 287, 288, 289, 290, 291, 292, 293, 294, 295, 296, 297, 298, 299, 303, 304, 305, 306, 307, 308, 309, 310, 311,
315, 316, 317, 321, 322, 323, 327, 328, 329, 333, 334, 335, 340, 341, 345, 346, 347, 348, 349, 350, 351, 352, 353, 354, 355, 356, 357,
358, 359, 363, 364, 365, 366, 367, 368, 369, 370, 371, 375, 376, 377, 381, 382, 383, 387, 388, 389, 393, 394, 395, 396, 398, 399, 400, 401,
403, 405, 406, 407, 408, 409, 410, 411, 412, 413, 414, 416, 417, 418, 419, 423, 424, 425, 426, 428, 429, 430, 431, 432, 434, 435, 436, 437,
438, 440, 441, 442, 443, 447, 448, 449, 454, 455, 460, 461, 466, 467, 472, 473, 478, 479, 485, 488, 491, 494, 2215, 2221, 2227, 2241, 2247,
2261, 2267, 2281, 2291, 2293, 2338, 2359, 2406, 2719, 2787, 2858, 2878, 3026, 3036, 3046, 3056, 3066, 3076, 3086, 3096, 3211, 3215,
3262, 3358, 3374, 3514, 3519, 3531, 3535, 3563, 3583, 3694, 3715, 3726, 3742, 3758, 3789, 498, 527, 582, 597, 626, 641, 716, 731, 762,
806, 812, 962, 981, 1013, 1094, 1142, 1197, 1213, 1221, 1229, 1306, 1308, 1310, 1313, 1320, 1323, 1330, 1333, 1340, 1343, 1350, 1358,
1361, 1365, 1369, 1374, 1376, 1380, 1384, 1388, 1392, 1394, 1868, 1908, 1948, 1964, 1988, 1996, 2004, 2028, 2044, 2068, 2108, 2148,
2180, 2186, 2190, 2194, 2198, 2202, 3863, 3914, 3935, 3986, 4007, 3862, 3896, 3898, 3931, 3934, 3968, 3970, 4003, 4006, 4040, 4042,
4075, 4078, 4112, 4114, 4147, 4184, 4187, 4189, 4191, 4192, 4193, 4195, 4196, 4197, 4199, 4200, 4203, 4434, 4439, 4444, 4449]
78, 452, [1, 3, 6, 7, 8, 11, 12, 13, 17, 18, 25, 27, 28, 29, 30, 31, 32, 34, 35, 36, 37, 38, 39, 40, 41, 42, 46, 48, 49, 52, 53, 54, 57, 58, 59, 61, 62,
63, 64, 67, 70, 72, 75, 76, 77, 80, 81, 82, 85, 86, 87, 91, 93, 94, 97, 98, 99, 102, 103, 104, 106, 107, 108, 109, 112, 115, 117, 119, 120, 121,
122, 123, 124, 125, 126, 127, 128, 129, 130, 131, 132, 136, 138, 139, 141, 142, 143, 144, 146, 147, 148, 149, 152, 153, 154, 157, 160, 162,
165, 166, 167, 170, 171, 172, 175, 176, 177, 181, 183, 184, 187, 188, 189, 192, 193, 194, 197, 198, 199, 202, 206, 211, 216, 220, 221, 227,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

230, 233, 236, 239, 243, 244, 245, 246, 247, 249, 250, 251, 252, 255, 256, 257, 258, 259, 261, 262, 263, 264, 265, 267, 268, 269, 270, 271, 272, 273, 274, 275, 276, 277, 278, 279, 280, 281, 285, 286, 287, 288, 290, 291, 292, 293, 294, 295, 296, 297, 298, 299, 303, 304, 305, 306, 307, 308, 309, 310, 311, 315, 316, 317, 321, 322, 323, 324, 325, 326, 327, 328, 329, 330, 331, 332, 333, 334, 335, 336, 337, 338, 339, 340, 341, 345, 346, 347, 349, 351, 352, 353, 354, 355, 356, 357, 358, 359, 363, 364, 365, 366, 367, 368, 369, 370, 371, 373, 375, 376, 377, 378, 379, 380, 381, 382, 383, 384, 385, 386, 387, 388, 389, 390, 391, 392, 393, 394, 395, 396, 397, 398, 399, 400, 401, 402, 404, 405, 406, 407, 408, 410, 411, 412, 413, 417, 418, 419, 423, 424, 425, 429, 430, 431, 435, 436, 437, 441, 442, 443, 444, 445, 446, 447, 448, 449, 450, 452, 454, 455, 456, 458, 460, 461, 466, 467, 472, 473, 478, 479, 485, 488, 491, 492, 494, 2207, 2221, 2227, 2241, 2247, 2261, 2267, 2281, 2291, 2293, 2338, 2406, 2627, 2658, 2679, 2766, 2786, 2806, 3026, 3036, 3046, 3056, 3066, 3076, 3078, 3096, 3262, 3358, 3439, 3503, 3614, 3646, 3662, 3678, 3707, 3789, 527, 597, 626, 644, 698, 716, 723, 797, 866, 933, 962, 981, 1029, 1070, 1102, 1181, 1189, 1305, 1308, 1310, 1312, 1320, 1322, 1330, 1332, 1340, 1342, 1350, 1357, 1361, 1365, 1369, 1374, 1376, 1380, 1384, 1388, 1391, 1393, 1868, 1948, 1964, 2004, 2028, 2108, 2164, 2172, 2180, 2186, 2190, 2194, 2198, 3863, 3914, 3935, 3958, 3977, 4102, 3826, 3862, 3894, 3896, 3897, 3898, 3931, 3934, 3966, 3968, 3969, 3970, 4003, 4006, 4038, 4040, 4041, 4042, 4075, 4078, 4110, 4112, 4113, 4114, 4147, 4182, 4184, 4185, 4187, 4188, 4189, 4191, 4192, 4193, 4195, 4196, 4197, 4199, 4200, 4203, 4434, 4439, 4444, 4448, 4449, 4451, 4454]
79, 442, [3, 6, 7, 8, 11, 12, 13, 17, 18, 25, 27, 28, 29, 30, 31, 32, 34, 35, 36, 37, 39, 40, 41, 42, 48, 49, 52, 53, 54, 57, 58, 59, 61, 62, 63, 64, 67, 70, 72, 74, 75, 76, 77, 79, 80, 81, 82, 84, 85, 86, 87, 91, 93, 94, 95, 96, 97, 98, 99, 101, 102, 103, 104, 105, 106, 107, 108, 109, 112, 115, 117, 119, 120, 121, 122, 125, 126, 127, 129, 130, 131, 132, 136, 138, 139, 140, 141, 142, 143, 144, 146, 147, 148, 149, 150, 151, 152, 153, 154, 157, 160, 162, 164, 165, 166, 167, 169, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 252, 255, 256, 257, 258, 261, 262, 263, 267, 268, 269, 273, 274, 275, 279, 280, 281, 285, 286, 287, 288, 289, 290, 291, 292, 293, 294, 295, 296, 297, 298, 299, 303, 304, 305, 306, 307, 308, 309, 310, 311, 313, 315, 316, 317, 319, 321, 322, 323, 325, 327, 328, 329, 333, 334, 335, 336, 337, 338, 339, 340, 341, 342, 344, 345, 346, 347, 348, 349, 350, 351, 352, 353, 354, 355, 356, 357, 358, 359, 363, 364, 365, 366, 367, 368, 369, 370, 371, 375, 376, 377, 378, 379, 380, 381, 382, 383, 384, 386, 387, 388, 389, 393, 394, 395, 396, 398, 399, 400, 401, 403, 405, 406, 407, 408, 409, 410, 411, 412, 413, 414, 416, 417, 418, 419, 423, 424, 425, 426, 428, 429, 430, 431, 432, 434, 435, 436, 437, 438, 440, 441, 442, 443, 447, 448, 449, 454, 455, 460, 461, 466, 467, 472, 473, 478, 479, 485, 488, 491, 494, 2215, 2221, 2227, 2241, 2247, 2261, 2267, 2281, 2291, 2293, 2338, 2499, 2519, 2539, 2606, 2787, 2858, 2878, 3026, 3036, 3046, 3056, 3066, 3076, 3086, 3096, 3215, 3246, 3262, 3343, 3359, 3375, 3502, 3531, 3563, 3583, 3694, 3715, 3726, 3742, 3758, 3789, 498, 527, 582, 626, 672, 675, 716, 731, 742, 806, 812, 962, 981, 989, 997, 1014, 1022, 1101, 1142, 1197, 1213, 1221, 1229, 1306, 1308, 1310, 1313, 1320, 1323, 1330, 1333, 1340, 1343, 1350, 1358, 1361, 1365, 1369, 1374, 1376, 1380, 1384, 1388, 1392, 1394, 1472, 1868, 1908, 1948, 1988, 2028, 2068, 2108, 2148, 2180, 2186, 2190, 2194, 2198, 2202, 3863, 3914, 3935, 4007, 4037, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4197, 4199, 4200, 4203, 4434, 4439, 4444, 4449]
80, 426, [3, 8, 11, 13, 17, 18, 25, 27, 29, 30, 31, 32, 35, 36, 37, 40, 41, 42, 48, 49, 52, 53, 54, 56, 57, 58, 59, 62, 63, 64, 67, 70, 72, 74, 75, 76, 77, 80, 81, 82, 85, 86, 87, 93, 94, 96, 97, 98, 99, 101, 102, 103, 104, 105, 106, 107, 108, 109, 112, 115, 117, 118, 119, 120, 121, 122, 124, 125, 126, 127, 129, 130, 131, 132, 138, 139, 142, 143, 144, 146, 147, 148, 149, 152, 153, 154, 157, 160, 162, 164, 165, 166, 167, 170, 171, 172, 174, 175, 176, 177, 183, 184, 186, 187, 188, 189, 191, 192, 193, 194, 197, 198, 199, 202, 206, 210, 211, 214, 215, 216, 221, 227, 230, 233, 236, 239, 243, 244, 245, 246, 247, 249, 250, 251, 252, 253, 255, 256, 257, 261, 262, 263, 267, 268, 269, 273, 274, 275, 279, 280, 281, 285, 286, 287, 288, 289, 290, 291, 292, 293, 297, 298, 299, 303, 304, 305, 306, 307, 308, 309, 310, 311, 312, 313, 314, 315, 316, 317, 321, 322, 323, 327, 328, 329, 333, 334, 335, 339, 340, 341, 343, 345, 346, 347, 348, 349, 350, 351, 352, 353, 355, 357, 358, 359, 360, 362, 363, 364, 365, 366, 367, 368, 369, 370, 371, 372, 373, 374, 375, 376, 377, 378, 380, 381, 382, 383, 387, 388, 389, 393, 394, 395, 399, 400, 401, 405, 406, 407, 408, 409, 410, 411, 412, 413, 417, 418, 419, 423, 424, 425, 426, 427, 428, 429, 430, 431, 432, 433, 434, 435, 436, 437, 441, 442, 443, 447, 448, 449, 454, 455, 456, 458, 460, 461, 466, 467, 468, 472, 473, 478, 479, 485, 486, 488, 489, 491, 494, 2215, 2221, 2235, 2241, 2255, 2261, 2267, 2281, 2291, 2293, 2587, 2607, 2647, 2658, 2698, 2967, 2986, 3026, 3036, 3038, 3056, 3058, 3076, 3086, 3096, 3403, 3407, 3423, 3455, 3566, 3582, 3614, 3674, 3679, 3715, 3743, 3789, 3794, 515, 527, 542, 605, 632, 678, 785, 812, 841, 887, 913, 934, 1046, 1070, 1125, 1149, 1174, 1253, 1306, 1308, 1310, 1313, 1320, 1323, 1327, 1329, 1333, 1340, 1343, 1350, 1358, 1362, 1365, 1369, 1374, 1376, 1380, 1383, 1387, 1392, 1394, 1868, 1892, 1900, 1908, 1916, 1924, 1940, 1948, 1972, 1980, 1988, 2060, 2068, 2108, 2140, 2148, 2180, 2186, 2202, 3877, 3921, 3949, 4065, 4093, 4116, 3862, 3896, 3898, 3931, 3934, 3968, 3970, 4003, 4005, 4006, 4040, 4042, 4075, 4078, 4112, 4114, 4147, 4184, 4187, 4191, 4195, 4196, 4197, 4199, 4200, 4203, 4434, 4438, 4439, 4441, 4443, 4444, 4446, 4449]
81, 463, [3, 6, 7, 8, 11, 12, 13, 17, 18, 25, 27, 28, 29, 30, 31, 32, 34, 35, 36, 37, 39, 40, 41, 42, 46, 48, 49, 52, 53, 54, 57, 58, 59, 61, 62, 63, 64, 67, 70, 72, 75, 76, 77, 80, 81, 82, 84, 85, 86, 87, 91, 93, 94, 95, 96, 97, 98, 99, 101, 102, 103, 104, 107, 108, 109, 112, 115, 117, 118, 119, 120, 121, 122, 124, 125, 126, 127, 129, 130, 131, 132, 136, 138, 139, 142, 143, 144, 147, 148, 149, 151, 152, 153, 154, 157, 160, 162, 164, 165, 166, 167, 170, 171, 172, 174, 175, 176, 177, 181, 183, 184, 185, 186, 187, 188, 189, 191, 192, 193, 194, 195, 196, 197, 198, 199, 202, 206, 209, 210, 211, 214, 215, 216, 219, 220, 221, 227, 230, 233, 236, 239, 243, 244, 245, 246, 247, 249, 250, 251, 252, 255, 256, 257, 258, 259, 261, 262, 263, 265, 267, 268, 269, 273, 274, 275, 276, 277, 278, 279, 280, 281, 285, 286, 287, 288, 290, 291, 292, 293, 294, 296, 297, 298, 299, 303, 304, 305, 309, 310, 311, 315, 316, 317, 318, 319, 320, 321, 322, 323, 324, 325, 326, 327, 328, 329, 333, 334, 335, 336, 337, 338, 339, 340, 341, 343, 345, 346, 347, 349, 351, 352, 353, 357, 358, 359, 363, 364, 365, 366, 367, 368, 369, 370, 371, 372, 374, 375, 376, 377, 378, 379, 380, 381, 382, 383, 384, 385, 386, 387, 388, 389, 393, 394, 395, 396, 397, 398, 399, 400, 401, 405, 406, 407, 408, 409, 410, 411, 412, 413, 414, 415, 416, 417, 418, 419, 423, 424, 425, 426, 427, 428, 429, 430, 431, 435, 436, 437, 438, 439, 440, 441, 442, 443, 444, 446, 447, 448, 449, 454, 455, 456, 458, 460, 461, 466, 467, 468, 470, 472, 473, 474, 476, 478, 479, 483, 485, 486, 488, 489, 491, 494, 2215, 2221, 2227, 2241, 2247, 2261, 2267, 2281, 2291, 2293, 2338, 2359, 2446, 2607, 2627, 2698, 2967, 3026, 3036, 3038, 3056, 3058, 3076, 3096, 3215, 3262, 3326, 3423, 3439, 3582, 3691, 3715, 3723, 3743, 3789, 3818, 498, 527, 582, 585, 608, 626, 652, 675, 707, 765, 806, 821, 832, 896, 902, 962, 981, 1029, 1037, 1054, 1062, 1118, 1141, 1222, 1277, 1306, 1308, 1310, 1313, 1320, 1323, 1330, 1333, 1340, 1343, 1350, 1358, 1361, 1365, 1369, 1374, 1376, 1379, 1383, 1387, 1389, 1392, 1394, 1868, 1908, 1948, 1964, 1988, 2020, 2028, 2068, 2108, 2124, 2148, 2186, 3863, 3905, 3965, 4007, 4037, 4049, 4058, 4079, 4109, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4197, 4199, 4200, 4203, 4434, 4436, 4438, 4439, 4441, 4443, 4444, 4446, 4449]
82, 438, [1, 3, 7, 8, 13, 16, 17, 18, 25, 27, 29, 30, 31, 32, 35, 36, 37, 39, 40, 41, 42, 46, 48, 49, 52, 53, 54, 57, 58, 59, 61, 62, 63, 64, 67, 70, 72, 74, 75, 76, 77, 78, 79, 80, 81, 82, 84, 85, 86, 87, 91, 93, 94, 95, 96, 97, 98, 99, 100, 101, 102, 103, 104, 105, 106, 107, 108, 109, 112, 115, 117, 118, 119, 120, 121, 122, 124, 125, 126, 127, 129, 130, 131, 132, 138, 139, 142, 143, 144, 147, 148, 149, 151, 152, 153, 154, 157, 160, 162, 164, 165, 166, 167, 170, 171, 172, 175, 176, 177, 183, 184, 187, 188, 189, 192, 193, 194, 196, 197, 198, 199, 202, 205, 206, 209, 210, 211, 216, 221, 227, 230, 233, 236, 239, 243, 244, 245, 246, 247, 249, 250, 251, 255, 256, 257, 258, 259, 261, 262, 263, 264, 265, 267, 268, 269, 273, 274, 275, 276, 277, 278, 279, 280, 281, 285, 286, 287, 288, 289, 290, 291, 292, 293, 294, 295, 296, 297, 298, 299, 303, 304, 305, 306, 307, 308, 309, 310, 311, 313, 315, 316, 317, 318, 319, 320, 321, 322, 323, 324, 326, 327, 328, 329, 333, 334, 335, 336, 338, 339, 340, 341, 342, 343, 344, 345, 346, 347, 348, 349, 350, 351, 352, 353, 354, 355, 356, 357, 358, 359, 363, 364, 365, 366, 367, 368, 369, 370, 371, 372, 374, 375, 376, 377, 378, 380, 381, 382, 383, 387, 388, 389, 393, 394, 395, 399, 400, 401, 405, 406, 407, 408, 409, 410, 411, 412,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

413, 414, 415, 416, 417, 418, 419, 423, 424, 425, 426, 427, 428, 429, 430, 431, 435, 436, 437, 441, 442, 443, 447, 448, 449, 454, 455, 460, 461, 466, 467, 468, 470, 472, 473, 474, 476, 478, 479, 483, 485, 488, 491, 494, 2215, 2221, 2227, 2241, 2255, 2261, 2267, 2281, 2293, 2499, 2698, 3018, 3036, 3056, 3066, 3076, 3086, 3096, 3138, 3343, 3371, 3403, 3534, 3566, 3582, 3715, 3755, 3789, 495, 507, 518, 551, 562, 585, 626, 716, 806, 821, 896, 903, 1022, 1141, 1149, 1306, 1310, 1313, 1320, 1323, 1330, 1333, 1340, 1343, 1350, 1357, 1361, 1366, 1369, 1371, 1374, 1376, 1379, 1381, 1384, 1388, 1392, 1394, 1868, 1884, 1908, 1924, 1948, 1988, 2028, 2068, 2108, 2124, 2132, 2140, 2148, 2156, 2164, 2186, 2194, 2198, 2202, 3863, 3893, 3905, 3914, 3935, 3965, 4007, 4058, 4079, 4130, 3859, 3862, 3896, 3898, 3931, 3934, 3968, 3970, 4003, 4006, 4040, 4042, 4075, 4078, 4112, 4114, 4147, 4184, 4187, 4188, 4189, 4191, 4192, 4195, 4197, 4199, 4200, 4203, 4433, 4434, 4436, 4439, 4444, 4449]
83, 399, [3, 6, 7, 8, 11, 12, 13, 17, 18, 25, 27, 30, 31, 32, 33, 34, 35, 36, 37, 39, 40, 41, 42, 48, 49, 51, 52, 53, 54, 55, 56, 57, 58, 59, 62, 63, 64, 67, 70, 72, 75, 76, 77, 79, 80, 81, 82, 85, 86, 87, 93, 94, 97, 98, 99, 101, 102, 103, 104, 107, 108, 109, 112, 115, 117, 120, 121, 122, 125, 126, 127, 130, 131, 132, 138, 139, 142, 143, 144, 146, 147, 148, 149, 152, 153, 154, 157, 160, 162, 165, 166, 167, 169, 170, 171, 172, 175, 176, 177, 183, 184, 187, 188, 189, 191, 192, 193, 194, 197, 198, 199, 202, 206, 211, 216, 221, 227, 230, 233, 236, 239, 243, 244, 245, 249, 250, 251, 252, 253, 255, 256, 257, 258, 259, 261, 262, 263, 267, 268, 269, 273, 274, 275, 276, 278, 279, 280, 281, 282, 283, 284, 285, 286, 287, 288, 289, 290, 291, 292, 293, 297, 298, 299, 303, 304, 305, 309, 310, 311, 312, 313, 314, 315, 316, 317, 321, 322, 323, 327, 328, 329, 333, 334, 335, 339, 340, 341, 342, 344, 345, 346, 347, 348, 350, 351, 352, 353, 357, 358, 359, 363, 364, 365, 369, 370, 371, 375, 376, 377, 381, 382, 383, 387, 388, 389, 393, 394, 395, 399, 400, 401, 403, 405, 406, 407, 411, 412, 413, 417, 418, 419, 423, 424, 425, 429, 430, 431, 432, 433, 434, 435, 436, 437, 441, 442, 443, 447, 448, 449, 454, 455, 460, 461, 462, 464, 466, 467, 468, 470, 472, 473, 478, 479, 485, 488, 491, 494, 2215, 2221, 2227, 2241, 2247, 2261, 2281, 2291, 2293, 2406, 2606, 2787, 2966, 3026, 3036, 3046, 3056, 3066, 3076, 3086, 3096, 3130, 3358, 3502, 3583, 3594, 3599, 3715, 3789, 3802, 498, 571, 588, 616, 651, 688, 706, 778, 831, 868, 886, 1013, 1101, 1109, 1142, 1261, 1269, 1306, 1308, 1310, 1313, 1320, 1323, 1330, 1333, 1340, 1343, 1350, 1358, 1361, 1365, 1367, 1370, 1374, 1376, 1380, 1384, 1388, 1392, 1394, 1868, 1876, 1900, 1908, 1940, 1948, 1956, 1980, 1988, 1996, 2020, 2028, 2036, 2052, 2060, 2068, 2076, 2100, 2108, 2116, 2132, 2140, 2148, 2156, 2180, 2186, 2190, 2198, 2202, 3870, 3942, 4086, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4199, 4203, 4434, 4434, 4439, 4444, 4449]
84, 403, [3, 6, 8, 11, 12, 13, 16, 17, 18, 25, 27, 29, 30, 31, 32, 34, 35, 36, 37, 40, 41, 42, 48, 49, 51, 52, 53, 54, 57, 58, 59, 61, 62, 63, 64, 67, 70, 72, 75, 76, 77, 79, 80, 81, 82, 85, 86, 87, 93, 94, 96, 97, 98, 99, 102, 103, 104, 107, 108, 109, 112, 115, 117, 120, 121, 122, 124, 125, 126, 127, 130, 131, 132, 138, 139, 142, 143, 144, 147, 148, 149, 152, 153, 154, 157, 160, 162, 165, 166, 167, 169, 170, 171, 172, 175, 176, 177, 183, 184, 186, 187, 188, 189, 192, 193, 194, 197, 198, 199, 202, 206, 211, 214, 215, 216, 221, 227, 230, 233, 236, 239, 243, 244, 245, 246, 249, 250, 251, 252, 253, 255, 256, 257, 258, 259, 261, 262, 263, 267, 268, 269, 273, 274, 275, 279, 280, 281, 282, 283, 284, 285, 286, 287, 291, 292, 293, 294, 296, 297, 298, 299, 303, 304, 305, 309, 310, 311, 312, 313, 314, 315, 316, 317, 318, 319, 320, 321, 322, 323, 327, 328, 329, 333, 334, 335, 339, 340, 341, 342, 343, 344, 345, 346, 347, 351, 352, 353, 357, 358, 359, 363, 364, 365, 369, 370, 371, 372, 374, 375, 376, 377, 378, 380, 381, 382, 383, 387, 388, 389, 393, 394, 395, 399, 400, 401, 405, 406, 407, 411, 412, 413, 417, 418, 419, 423, 424, 425, 429, 430, 431, 435, 436, 437, 439, 441, 442, 443, 447, 448, 449, 454, 455, 460, 461, 462, 464, 466, 467, 472, 473, 478, 479, 485, 486, 488, 489, 491, 494, 2215, 2221, 2235, 2241, 2247, 2261, 2267, 2281, 2293, 2318, 2698, 2879, 3026, 3036, 3046, 3056, 3058, 3076, 3086, 3096, 3138, 3163, 3278, 3326, 3582, 3658, 3663, 3679, 3715, 3789, 505, 595, 626, 642, 685, 732, 754, 844, 865, 912, 934, 1037, 1141, 1149, 1182, 1306, 1310, 1313, 1320, 1323, 1330, 1333, 1340, 1343, 1350, 1358, 1361, 1365, 1369, 1371, 1374, 1376, 1380, 1383, 1387, 1392, 1394, 1868, 1900, 1908, 1916, 1948, 1980, 1988, 1996, 2012, 2020, 2028, 2036, 2060, 2068, 2076, 2092, 2100, 2108, 2116, 2140, 2148, 2156, 2172, 2180, 2186, 2190, 2202, 3863, 3885, 3913, 3957, 3985, 4129, 3859, 3862, 3896, 3898, 3931, 3934, 3968, 3970, 4003, 4006, 4040, 4042, 4075, 4078, 4112, 4114, 4147, 4184, 4187, 4191, 4192, 4193, 4195, 4196, 4197, 4199, 4200, 4203, 4434, 4439, 4441, 4443, 4444, 4446, 4449]
85, 451, [1, 3, 7, 8, 11, 13, 17, 18, 25, 27, 29, 30, 31, 32, 35, 36, 37, 40, 41, 42, 46, 48, 49, 52, 53, 54, 56, 57, 58, 59, 62, 63, 64, 67, 70, 72, 73, 74, 75, 76, 77, 79, 80, 81, 82, 83, 84, 85, 86, 87, 91, 93, 94, 95, 96, 97, 98, 99, 100, 101, 102, 103, 104, 107, 108, 109, 112, 115, 117, 118, 119, 120, 121, 122, 124, 125, 126, 127, 130, 131, 132, 138, 139, 141, 142, 143, 144, 145, 146, 147, 148, 149, 152, 153, 154, 157, 160, 162, 164, 165, 166, 167, 170, 171, 172, 174, 175, 176, 177, 181, 183, 184, 187, 188, 189, 191, 192, 193, 194, 197, 198, 199, 202, 206, 209, 210, 211, 216, 221, 227, 230, 233, 236, 239, 243, 244, 245, 246, 247, 249, 250, 251, 252, 253, 255, 256, 257, 261, 262, 263, 264, 265, 267, 268, 269, 270, 272, 273, 274, 275, 276, 277, 278, 279, 280, 281, 285, 286, 287, 288, 289, 290, 291, 292, 293, 297, 298, 299, 303, 304, 305, 306, 307, 308, 309, 310, 311, 312, 313, 314, 315, 316, 317, 319, 321, 322, 323, 324, 326, 327, 328, 329, 333, 334, 335, 336, 338, 339, 340, 341, 342, 343, 344, 345, 346, 347, 348, 349, 350, 351, 352, 353, 357, 358, 359, 363, 364, 365, 366, 367, 368, 369, 370, 371, 372, 373, 374, 375, 376, 377, 378, 379, 380, 381, 382, 383, 387, 388, 389, 393, 394, 395, 397, 399, 400, 401, 402, 404, 405, 406, 407, 408, 409, 410, 411, 412, 413, 417, 418, 419, 423, 424, 425, 426, 427, 428, 429, 430, 431, 432, 433, 434, 435, 436, 437, 438, 440, 441, 442, 443, 445, 447, 448, 449, 454, 455, 456, 458, 460, 461, 466, 467, 468, 470, 472, 473, 478, 479, 483, 485, 486, 488, 491, 494, 2207, 2221, 2241, 2255, 2261, 2267, 2281, 2291, 2293, 2519, 2767, 2899, 3026, 3036, 3038, 3056, 3066, 3076, 3086, 3096, 3114, 3227, 3359, 3371, 3390, 3534, 3567, 3695, 3711, 3715, 3789, 3818, 515, 527, 542, 596, 605, 632, 722, 768, 812, 832, 852, 866, 875, 902, 924, 1022, 1093, 1181, 1229, 1245, 1253, 1305, 1308, 1310, 1312, 1320, 1330, 1333, 1340, 1343, 1345, 1350, 1357, 1359, 1362, 1365, 1369, 1374, 1376, 1379, 1383, 1388, 1392, 1394, 1756, 1868, 1892, 1924, 1940, 1948, 2020, 2028, 2068, 2100, 2108, 2164, 2180, 2186, 2198, 3877, 3886, 3921, 3993, 4029, 4065, 4093, 4137, 3826, 3862, 3894, 3896, 3897, 3898, 3931, 3934, 3966, 3968, 3970, 4003, 4006, 4040, 4042, 4075, 4078, 4112, 4114, 4147, 4184, 4185, 4187, 4188, 4191, 4195, 4196, 4197, 4199, 4200, 4203, 4434, 4436, 4438, 4439, 4441, 4444, 4449]
86, 422, [3, 6, 7, 8, 11, 12, 13, 17, 18, 25, 27, 28, 29, 30, 31, 32, 33, 34, 35, 36, 37, 39, 40, 41, 42, 46, 48, 49, 50, 51, 52, 53, 54, 55, 56, 57, 58, 59, 62, 63, 64, 67, 70, 72, 74, 75, 76, 77, 80, 81, 82, 84, 85, 86, 87, 93, 94, 97, 98, 99, 101, 102, 103, 104, 107, 108, 109, 112, 115, 117, 119, 120, 121, 122, 125, 126, 127, 130, 131, 132, 138, 139, 142, 143, 144, 146, 147, 148, 149, 152, 153, 154, 157, 160, 162, 164, 165, 166, 167, 170, 171, 172, 175, 176, 177, 183, 184, 187, 188, 189, 191, 192, 193, 194, 197, 198, 199, 202, 206, 209, 210, 211, 216, 221, 227, 230, 233, 236, 239, 243, 244, 245, 249, 250, 251, 252, 253, 255, 256, 257, 258, 259, 261, 262, 263, 265, 267, 268, 269, 273, 274, 275, 276, 277, 278, 279, 280, 281, 282, 284, 285, 286, 287, 288, 289, 290, 291, 292, 293, 297, 298, 299, 303, 304, 305, 306, 307, 308, 309, 310, 311, 312, 313, 314, 315, 316, 317, 318, 320, 321, 322, 323, 324, 326, 327, 328, 329, 333, 334, 335, 339, 340, 341, 345, 346, 347, 348, 349, 350, 351, 352, 353, 357, 358, 359, 363, 364, 365, 366, 367, 368, 369, 370, 371, 372, 373, 374, 375, 376, 377, 381, 382, 383, 387, 388, 389, 393, 394, 395, 399, 400, 401, 405, 406, 407, 408, 409, 410, 411, 412, 413, 417, 418, 419, 423, 424, 425, 426, 427, 428, 429, 430, 431, 432, 433, 434, 435, 436, 437, 441, 442, 443, 447, 448, 449, 454, 455, 460, 461, 466, 467, 468, 470, 472, 473, 478, 479, 483, 485, 486, 488, 491, 494, 2215, 2221, 2227, 2241, 2247, 2261, 2281, 2291, 2293, 2359, 2538, 3026, 3036, 3038, 3056, 3066, 3076, 3086, 3096, 3130, 3162, 3167, 3215, 3406, 3715, 3789, 498, 582, 585, 632, 652, 672, 695, 722, 785, 812, 875, 902, 924, 1021, 1069, 1077, 1306, 1308, 1310, 1313, 1320, 1323, 1330, 1333, 1340, 1343, 1350, 1358, 1361, 1365, 1367, 1370, 1374, 1376, 1379, 1383, 1388, 1392, 1394, 1868, 1908, 1940, 1948, 1988, 2004, 2020, 2028, 2052, 2060, 2068, 2076, 2084, 2100, 2108, 2132, 2140, 2148, 2156, 2164, 2180, 2186, 2198, 2202, 3921, 3949, 3993, 4021, 4065, 4093, 4137, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4199, 4203, 4434, 4436, 4438, 4439, 4441, 4444, 4449]
87, 438, [3, 8, 13, 18, 25, 27, 30, 31, 32, 35, 36, 37, 40, 41, 42, 48, 49, 52, 53, 54, 57, 58, 59, 62, 63, 64, 67, 70, 72, 75, 76, 77, 79, 80, 81, 82, 85, 86, 87, 93, 94, 96, 97, 98, 99, 102, 103, 104, 106, 107, 108, 109, 112, 113, 115, 117, 118, 119, 120, 121, 122, 123, 124, 125, 126, 127,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

128, 129, 130, 131, 132, 136, 138, 139, 141, 142, 143, 144, 145, 146, 147, 148, 149, 152, 153, 154, 157, 160, 162, 165, 166, 167, 169, 170, 171, 172, 175, 176, 177, 183, 184, 187, 188, 189, 192, 193, 194, 197, 198, 199, 202, 206, 211, 216, 221, 227, 230, 233, 236, 239, 240, 241, 243, 244, 245, 249, 250, 251, 255, 256, 257, 261, 262, 263, 264, 265, 267, 268, 269, 270, 271, 272, 273, 274, 275, 279, 280, 281, 285, 286, 287, 291, 292, 293, 294, 295, 296, 297, 298, 299, 300, 301, 302, 303, 304, 305, 309, 310, 311, 315, 316, 317, 321, 322, 323, 324, 325, 326, 327, 328, 329, 330, 331, 332, 333, 334, 335, 339, 340, 341, 342, 343, 344, 345, 346, 347, 351, 352, 353, 354, 355, 356, 357, 358, 359, 360, 361, 362, 363, 364, 365, 366, 368, 369, 370, 371, 372, 373, 374, 375, 376, 377, 378, 379, 380, 381, 382, 383, 384, 385, 386, 387, 388, 389, 390, 392, 393, 394, 395, 396, 398, 399, 400, 401, 402, 404, 405, 406, 407, 408, 410, 411, 412, 413, 414, 416, 417, 418, 419, 420, 422, 423, 424, 425, 429, 430, 431, 432, 434, 435, 436, 437, 441, 442, 443, 444, 446, 447, 448, 449, 454, 455, 460, 461, 466, 467, 472, 473, 478, 479, 485, 488, 491, 494, 2207, 2221, 2235, 2241, 2255, 2261, 2275, 2281, 2287, 2293, 2766, 3026, 3036, 3046, 3056, 3066, 3076, 3086, 3096, 3338, 3343, 3579, 3611, 3678, 3715, 3742, 3774, 3789, 497, 528, 541, 572, 631, 651, 662, 685, 705, 796, 822, 842, 852, 1022, 1054, 1070, 1094, 1110, 1133, 1165, 1173, 1189, 1205, 1221, 1237, 1305, 1307, 1309, 1312, 1315, 1317, 1319, 1322, 1325, 1329, 1332, 1337, 1339, 1343, 1350, 1357, 1362, 1366, 1370, 1373, 1376, 1380, 1384, 1388, 1392, 1394, 1876, 1884, 1892, 1916, 1924, 1932, 1956, 1972, 1996, 2012, 2116, 2148, 2156, 2172, 2186, 2190, 2194, 2198, 2202, 3899, 3922, 3971, 3985, 4066, 3826, 3859, 3861, 3862, 3894, 3896, 3898, 3931, 3933, 3934, 3966, 3968, 3970, 4001, 4003, 4005, 4006, 4038, 4040, 4041, 4042, 4075, 4077, 4078, 4112, 4114, 4147, 4184, 4185, 4187, 4188, 4191, 4195, 4199, 4201, 4203, 4204, 4434, 4439, 4444, 4449]
88, 436, [1, 3, 7, 8, 13, 16, 17, 18, 25, 27, 29, 30, 31, 32, 35, 36, 37, 39, 40, 41, 42, 46, 48, 49, 52, 53, 54, 57, 58, 59, 61, 62, 63, 64, 67, 70, 72, 74, 75, 76, 77, 80, 81, 82, 84, 85, 86, 87, 91, 93, 94, 97, 98, 99, 102, 103, 104, 106, 107, 108, 109, 112, 115, 117, 119, 120, 121, 122, 123, 124, 125, 126, 127, 129, 130, 131, 132, 136, 138, 139, 140, 141, 142, 143, 144, 146, 147, 148, 149, 150, 151, 152, 153, 154, 157, 160, 162, 164, 165, 166, 167, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 255, 256, 257, 258, 259, 261, 262, 263, 264, 265, 267, 268, 269, 273, 274, 275, 276, 277, 278, 279, 280, 281, 285, 286, 287, 288, 289, 290, 291, 292, 293, 294, 295, 296, 297, 298, 299, 303, 304, 305, 306, 307, 308, 309, 310, 311, 315, 316, 317, 318, 319, 320, 321, 322, 323, 324, 325, 326, 327, 328, 329, 333, 334, 335, 336, 337, 338, 339, 340, 341, 345, 346, 347, 348, 349, 350, 351, 352, 353, 354, 355, 356, 357, 358, 359, 363, 364, 365, 366, 367, 368, 369, 370, 371, 373, 375, 376, 377, 378, 379, 380, 381, 382, 383, 384, 386, 387, 388, 389, 393, 394, 395, 396, 398, 399, 400, 401, 402, 403, 404, 405, 406, 407, 408, 410, 411, 412, 413, 414, 415, 416, 417, 418, 419, 423, 424, 425, 426, 428, 429, 430, 431, 435, 436, 437, 438, 440, 441, 442, 443, 447, 448, 449, 454, 455, 460, 461, 466, 467, 472, 473, 478, 479, 485, 488, 491, 494, 2215, 2221, 2227, 2241, 2255, 2261, 2267, 2281, 2293, 2679, 2786, 2838, 2878, 3026, 3036, 3046, 3056, 3066, 3076, 3086, 3096, 3138, 3503, 3531, 3563, 3595, 3662, 3694, 3715, 3726, 3742, 3758, 3774, 3789, 495, 507, 518, 551, 562, 585, 626, 641, 652, 675, 716, 806, 813, 833, 1102, 1213, 1229, 1306, 1310, 1313, 1320, 1323, 1330, 1333, 1340, 1343, 1350, 1357, 1361, 1366, 1369, 1371, 1374, 1376, 1380, 1384, 1388, 1392, 1394, 1868, 1884, 1908, 1924, 1948, 1964, 1988, 2004, 2028, 2068, 2108, 2148, 2186, 2190, 2194, 2198, 2202, 3863, 3893, 3905, 3914, 3935, 3965, 3977, 3986, 4007, 4037, 3859, 3862, 3896, 3898, 3931, 3934, 3968, 3970, 4003, 4006, 4040, 4042, 4075, 4078, 4112, 4114, 4147, 4184, 4187, 4188, 4189, 4191, 4192, 4195, 4197, 4199, 4200, 4203, 4434, 4439, 4444, 4449]
89, 447, [3, 6, 7, 8, 11, 12, 13, 17, 18, 25, 27, 28, 29, 30, 31, 32, 33, 34, 35, 36, 37, 39, 40, 41, 42, 46, 48, 49, 50, 51, 52, 53, 54, 56, 57, 58, 59, 60, 61, 62, 63, 64, 67, 70, 72, 74, 75, 76, 77, 80, 81, 82, 84, 85, 86, 87, 91, 93, 94, 97, 98, 99, 102, 103, 104, 106, 107, 108, 109, 112, 115, 117, 119, 120, 121, 122, 123, 124, 125, 126, 127, 129, 130, 131, 132, 136, 138, 139, 140, 141, 142, 143, 144, 145, 146, 147, 148, 149, 150, 151, 152, 153, 154, 157, 160, 162, 164, 165, 166, 167, 169, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 252, 253, 255, 256, 257, 258, 259, 261, 262, 263, 265, 267, 268, 269, 273, 274, 275, 276, 277, 278, 279, 280, 281, 282, 284, 285, 286, 287, 288, 289, 290, 291, 292, 293, 294, 295, 296, 297, 298, 299, 303, 304, 305, 306, 307, 308, 309, 310, 311, 315, 316, 317, 318, 319, 320, 321, 322, 323, 324, 325, 326, 327, 328, 329, 333, 334, 335, 336, 337, 338, 339, 340, 341, 345, 346, 347, 348, 349, 350, 351, 352, 353, 354, 355, 356, 357, 358, 359, 363, 364, 365, 366, 367, 368, 369, 370, 371, 373, 375, 376, 377, 378, 379, 380, 381, 382, 383, 384, 386, 387, 388, 389, 393, 394, 395, 396, 398, 399, 400, 401, 402, 403, 404, 405, 406, 407, 408, 409, 410, 411, 412, 413, 414, 416, 417, 418, 419, 423, 424, 425, 426, 428, 429, 430, 431, 432, 434, 435, 436, 437, 438, 440, 441, 442, 443, 447, 448, 449, 454, 455, 460, 461, 466, 467, 472, 473, 478, 479, 485, 488, 491, 494, 2215, 2221, 2227, 2241, 2247, 2261, 2267, 2281, 2291, 2293, 2359, 2426, 2679, 2858, 2878, 3026, 3036, 3046, 3056, 3066, 3076, 3086, 3096, 3215, 3342, 3503, 3531, 3563, 3694, 3715, 3726, 3742, 3758, 3789, 498, 527, 582, 585, 626, 641, 652, 675, 716, 806, 812, 962, 1021, 1102, 1197, 1213, 1221, 1229, 1306, 1308, 1310, 1313, 1320, 1323, 1330, 1333, 1340, 1343, 1350, 1358, 1361, 1365, 1369, 1374, 1376, 1380, 1384, 1388, 1392, 1394, 1868, 1908, 1948, 1988, 2004, 2028, 2068, 2108, 2148, 2180, 2186, 2190, 2194, 2198, 2202, 3863, 3935, 3965, 3977, 3986, 4007, 4037, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4197, 4199, 4200, 4203, 4434, 4439, 4444, 4449]
90, 441, [3, 8, 13, 16, 17, 18, 25, 27, 29, 30, 31, 32, 35, 36, 37, 40, 41, 42, 48, 49, 52, 53, 54, 57, 58, 59, 61, 62, 63, 64, 67, 70, 72, 74, 75, 76, 77, 80, 81, 82, 85, 86, 87, 93, 94, 96, 97, 98, 99, 101, 102, 103, 104, 105, 106, 107, 108, 109, 112, 115, 117, 118, 119, 120, 121, 122, 124, 125, 126, 127, 129, 130, 131, 132, 136, 138, 139, 142, 143, 144, 147, 148, 149, 151, 152, 153, 154, 157, 160, 162, 164, 165, 166, 167, 170, 171, 172, 174, 175, 176, 177, 181, 183, 184, 185, 186, 187, 188, 189, 191, 192, 193, 194, 195, 196, 197, 198, 199, 202, 205, 206, 209, 210, 211, 214, 215, 216, 219, 220, 221, 227, 230, 233, 236, 239, 243, 244, 245, 246, 247, 249, 250, 251, 255, 256, 257, 261, 262, 263, 267, 268, 269, 273, 274, 275, 279, 280, 281, 285, 286, 287, 288, 289, 290, 291, 292, 293, 294, 295, 296, 297, 298, 299, 303, 304, 305, 306, 307, 308, 309, 310, 311, 315, 316, 317, 321, 322, 323, 327, 328, 329, 333, 334, 335, 337, 339, 340, 341, 343, 345, 346, 347, 348, 349, 350, 351, 352, 353, 354, 355, 356, 357, 358, 359, 363, 364, 365, 366, 367, 368, 369, 370, 371, 372, 374, 375, 376, 377, 378, 379, 380, 381, 382, 383, 385, 387, 388, 389, 393, 394, 395, 396, 397, 398, 399, 400, 401, 405, 406, 407, 408, 409, 410, 411, 412, 413, 414, 415, 416, 417, 418, 419, 423, 424, 425, 426, 427, 428, 429, 430, 431, 435, 436, 437, 438, 439, 440, 441, 442, 443, 444, 446, 447, 448, 449, 454, 455, 456, 458, 460, 461, 466, 467, 468, 470, 472, 473, 474, 476, 478, 479, 483, 485, 486, 488, 489, 491, 494, 2215, 2221, 2235, 2241, 2255, 2261, 2267, 2281, 2293, 2587, 2607, 2698, 2719, 2967, 3018, 3036, 3038, 3056, 3058, 3076, 3096, 3138, 3407, 3423, 3535, 3582, 3691, 3715, 3723, 3743, 3789, 3818, 518, 551, 626, 641, 678, 716, 762, 765, 806, 821, 832, 896, 903, 1062, 1070, 1141, 1222, 1306, 1310, 1313, 1320, 1323, 1330, 1333, 1340, 1343, 1350, 1358, 1362, 1366, 1369, 1371, 1374, 1376, 1379, 1383, 1387, 1389, 1392, 1394, 1868, 1884, 1892, 1900, 1908, 1916, 1924, 1948, 1964, 1972, 1980, 1988, 2028, 2068, 2108, 2124, 2148, 2186, 3863, 3914, 3935, 4007, 4049, 4058, 4079, 4109, 3859, 3862, 3896, 3898, 3931, 3934, 3968, 3970, 4003, 4006, 4040, 4042, 4075, 4078, 4112, 4114, 4147, 4184, 4187, 4191, 4195, 4197, 4199, 4200, 4203, 4433, 4434, 4436, 4438, 4439, 4441, 4443, 4444, 4446, 4449]
91, 447, [1, 3, 6, 7, 8, 12, 13, 18, 25, 27, 30, 31, 32, 35, 36, 37, 38, 39, 40, 41, 42, 46, 48, 49, 50, 51, 52, 53, 54, 57, 58, 59, 62, 63, 64, 67, 70, 72, 75, 76, 77, 80, 81, 82, 84, 85, 86, 87, 93, 94, 96, 97, 98, 99, 100, 101, 102, 103, 104, 106, 107, 108, 109, 112, 113, 115, 117, 119, 120, 121, 122, 123, 124, 125, 126, 127, 129, 130, 131, 132, 138, 139, 141, 142, 143, 144, 147, 148, 149, 151, 152, 153, 154, 157, 160, 162, 165, 166, 167, 170, 171, 172, 174, 175, 176, 177, 183, 184, 186, 187, 188, 189, 190, 191, 192, 193, 194, 196, 197, 198, 199, 202, 205, 206, 209, 210, 211, 214, 215, 216, 221, 227, 230, 233, 236, 239, 243, 244, 245, 249, 250, 251, 255, 256, 257, 258, 259, 261, 262, 263, 264, 265, 267, 268, 269, 270, 272, 273, 274, 275, 276, 277, 278, 279, 280, 281, 282, 283, 284, 285, 286, 287, 291, 292, 293, 297, 298, 299, 303, 304, 305, 309, 310, 311, 315, 316, 317, 318, 319, 320, 321, 322, 323, 327, 328, 329, 333, 334, 335, 336, 337, 338, 339, 340, 341, 342, 343, 344, 345, 346, 347, 349, 351, 352, 353, 357, 358, 359, 363, 364, 365, 366, 367, 368, 369, 370, 371, 372, 374, 375, 376, 377, 378, 379, 380, 381, 382,

TABLE 2-continued

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

383, 387, 388, 389, 393, 394, 395, 396, 397, 398, 399, 400, 401, 402, 403, 404, 405, 406, 407, 411, 412, 413, 414, 415, 416, 417, 418, 419, 420, 421, 422, 423, 424, 425, 426, 427, 428, 429, 430, 431, 435, 436, 437, 438, 439, 440, 441, 442, 443, 447, 448, 449, 454, 455, 456, 458, 460, 461, 462, 464, 466, 467, 472, 473, 474, 476, 478, 479, 483, 485, 486, 488, 489, 491, 494, 2207, 2221, 2227, 2241, 2261, 2275, 2281, 2291, 2293, 2386, 2627, 2678, 2987, 3006, 3018, 3036, 3038, 3056, 3058, 3076, 3086, 3096, 3122, 3374, 3439, 3450, 3455, 3466, 3471, 3598, 3715, 3759, 3786, 3789, 606, 661, 751, 786, 795, 841, 903, 934, 1005, 1054, 1062, 1141, 1222, 1253, 1305, 1308, 1310, 1312, 1315, 1320, 1323, 1333, 1339, 1343, 1347, 1350, 1357, 1361, 1363, 1366, 1370, 1374, 1376, 1379, 1383, 1387, 1392, 1394, 1868, 1876, 1884, 1932, 1940, 1948, 1956, 1964, 1988, 2060, 2068, 2124, 2140, 2148, 2202, 3878, 3950, 3972, 4044, 4085, 4094, 4116, 3826, 3862, 3894, 3896, 3898, 3931, 3934, 3968, 3970, 4003, 4005, 4006, 4040, 4042, 4073, 4075, 4077, 4078, 4112, 4114, 4147, 4184, 4185, 4187, 4188, 4189, 4191, 4192, 4195, 4199, 4203, 4433, 4434, 4436, 4438, 4439, 4441, 4443, 4444, 4446, 4449]
92, 413, [3, 8, 13, 16, 17, 18, 25, 27, 29, 30, 31, 32, 35, 36, 37, 40, 41, 42, 48, 49, 52, 53, 54, 57, 58, 59, 61, 62, 63, 64, 67, 70, 72, 74, 75, 76, 77, 80, 81, 82, 85, 86, 87, 91, 93, 94, 97, 98, 99, 102, 103, 104, 106, 107, 108, 109, 112, 115, 117, 119, 120, 121, 122, 124, 125, 126, 127, 129, 130, 131, 132, 136, 138, 139, 140, 141, 142, 143, 144, 145, 146, 147, 148, 149, 150, 151, 152, 153, 154, 157, 160, 162, 165, 166, 167, 169, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 255, 256, 257, 261, 262, 263, 267, 268, 269, 273, 274, 275, 279, 280, 281, 285, 286, 287, 288, 289, 290, 291, 292, 293, 294, 295, 296, 297, 298, 299, 303, 304, 305, 306, 307, 308, 309, 310, 311, 315, 316, 317, 321, 322, 323, 327, 328, 329, 333, 334, 335, 339, 340, 341, 345, 346, 347, 348, 349, 350, 351, 352, 353, 354, 355, 356, 357, 358, 359, 363, 364, 365, 366, 367, 368, 369, 370, 371, 373, 375, 376, 377, 379, 381, 382, 383, 384, 386, 387, 388, 389, 393, 394, 395, 396, 398, 399, 400, 401, 402, 403, 404, 405, 406, 407, 408, 410, 411, 412, 413, 414, 415, 416, 417, 418, 419, 423, 424, 425, 426, 428, 429, 430, 431, 432, 434, 435, 436, 437, 438, 440, 441, 442, 443, 447, 448, 449, 454, 455, 460, 461, 466, 467, 472, 473, 478, 479, 485, 488, 491, 494, 2215, 2221, 2235, 2241, 2255, 2261, 2267, 2281, 2293, 2679, 2699, 2838, 2878, 3026, 3036, 3046, 3056, 3066, 3076, 3086, 3096, 3138, 3402, 3407, 3503, 3519, 3531, 3563, 3694, 3715, 3726, 3742, 3774, 3789, 518, 551, 626, 641, 675, 716, 806, 813, 822, 824, 1078, 1102, 1189, 1213, 1221, 1229, 1306, 1310, 1313, 1320, 1323, 1330, 1333, 1340, 1343, 1350, 1358, 1362, 1366, 1369, 1371, 1374, 1376, 1380, 1384, 1388, 1392, 1394, 1868, 1884, 1892, 1900, 1908, 1916, 1924, 1948, 1964, 1972, 1980, 1988, 2004, 2028, 2068, 2108, 2148, 2172, 2186, 2190, 2194, 2198, 2202, 3863, 3914, 3935, 3986, 4007, 4037, 3859, 3862, 3896, 3898, 3931, 3934, 3968, 3970, 4003, 4006, 4040, 4042, 4075, 4078, 4112, 4114, 4147, 4184, 4187, 4191, 4195, 4197, 4199, 4200, 4203, 4434, 4439, 4444, 4449]
93, 448, [3, 6, 7, 8, 11, 12, 13, 17, 18, 25, 27, 28, 29, 30, 31, 32, 34, 35, 36, 37, 39, 40, 41, 42, 46, 48, 49, 52, 53, 54, 57, 58, 59, 61, 62, 63, 64, 67, 70, 72, 75, 76, 77, 80, 81, 82, 84, 85, 86, 87, 93, 94, 96, 97, 98, 99, 102, 103, 104, 107, 108, 109, 112, 115, 117, 118, 119, 120, 121, 122, 124, 125, 126, 127, 130, 131, 132, 136, 138, 139, 142, 143, 144, 147, 148, 149, 151, 152, 153, 154, 157, 160, 162, 164, 165, 166, 167, 170, 171, 172, 174, 175, 176, 177, 181, 183, 184, 185, 186, 187, 188, 189, 191, 192, 193, 194, 195, 196, 197, 198, 199, 202, 206, 209, 210, 211, 214, 215, 216, 219, 220, 221, 227, 230, 233, 236, 239, 243, 244, 245, 246, 247, 249, 250, 251, 252, 255, 256, 257, 258, 259, 261, 262, 263, 265, 267, 268, 269, 273, 274, 275, 276, 277, 278, 279, 280, 281, 285, 286, 287, 288, 290, 291, 292, 293, 294, 295, 296, 297, 298, 299, 303, 304, 305, 306, 308, 309, 310, 311, 315, 316, 317, 318, 319, 320, 321, 322, 323, 324, 326, 327, 328, 329, 333, 334, 335, 336, 338, 339, 340, 341, 345, 346, 347, 351, 352, 353, 357, 358, 359, 363, 364, 365, 369, 370, 371, 372, 374, 375, 376, 377, 381, 382, 383, 387, 388, 389, 393, 394, 395, 399, 400, 401, 405, 406, 407, 408, 409, 410, 411, 412, 413, 417, 418, 419, 423, 424, 425, 426, 427, 428, 429, 430, 431, 435, 436, 437, 441, 442, 443, 444, 446, 447, 448, 449, 454, 455, 456, 458, 460, 461, 466, 467, 468, 470, 472, 473, 474, 476, 478, 479, 483, 485, 486, 488, 489, 491, 494, 2215, 2221, 2227, 2241, 2247, 2261, 2267, 2281, 2293, 2338, 2359, 2478, 2586, 2607, 2967, 3026, 3036, 3038, 3056, 3058, 3076, 3096, 3215, 3262, 3419, 3423, 3454, 3482, 3487, 3518, 3562, 3567, 3582, 3610, 3615, 3674, 3679, 3691, 3715, 3723, 3743, 3789, 3818, 498, 527, 582, 585, 626, 633, 644, 652, 678, 697, 765, 821, 896, 902, 962, 981, 1029, 1053, 1062, 1077, 1093, 1110, 1141, 1158, 1222, 1277, 1306, 1308, 1310, 1313, 1320, 1323, 1330, 1333, 1340, 1343, 1350, 1358, 1361, 1365, 1369, 1374, 1376, 1379, 1383, 1387, 1389, 1392, 1394, 1868, 1908, 1948, 1964, 1988, 2012, 2028, 2060, 2068, 2108, 2124, 2148, 2186, 3863, 3905, 3914, 3965, 4058, 4079, 4109, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4197, 4199, 4200, 4203, 4434, 4436, 4438, 4439, 4441, 4443, 4444, 4446, 4449]
94, 426, [3, 6, 7, 8, 12, 13, 18, 25, 27, 30, 31, 32, 33, 34, 35, 36, 37, 39, 40, 41, 42, 46, 48, 49, 52, 53, 54, 56, 57, 58, 59, 62, 63, 64, 67, 70, 72, 75, 76, 77, 79, 80, 81, 82, 85, 86, 87, 93, 94, 97, 98, 99, 101, 102, 103, 104, 107, 108, 109, 112, 115, 117, 118, 119, 120, 121, 122, 124, 125, 126, 127, 129, 130, 131, 132, 138, 139, 141, 142, 143, 144, 145, 146, 147, 148, 149, 151, 152, 153, 154, 157, 160, 162, 165, 166, 167, 169, 170, 171, 172, 175, 176, 177, 183, 184, 187, 188, 189, 191, 192, 193, 194, 197, 198, 199, 202, 206, 210, 211, 214, 215, 216, 221, 227, 230, 233, 236, 239, 243, 244, 245, 249, 250, 251, 252, 253, 255, 256, 257, 258, 261, 262, 263, 267, 268, 269, 273, 274, 275, 276, 278, 279, 280, 281, 282, 283, 284, 285, 286, 287, 288, 289, 290, 291, 292, 293, 297, 298, 299, 303, 304, 305, 309, 310, 311, 312, 313, 314, 315, 316, 317, 321, 322, 323, 327, 328, 329, 333, 334, 335, 339, 340, 341, 342, 343, 344, 345, 346, 347, 348, 349, 350, 351, 352, 353, 357, 358, 359, 363, 364, 365, 367, 369, 370, 371, 372, 373, 374, 375, 376, 377, 379, 381, 382, 383, 387, 388, 389, 393, 394, 395, 396, 398, 399, 400, 401, 402, 403, 404, 405, 406, 407, 408, 409, 410, 411, 412, 413, 414, 416, 417, 418, 419, 423, 424, 425, 429, 430, 431, 432, 433, 434, 435, 436, 437, 441, 442, 443, 447, 448, 449, 454, 455, 460, 461, 462, 464, 466, 467, 468, 470, 472, 473, 478, 479, 485, 486, 488, 491, 494, 2215, 2221, 2227, 2241, 2247, 2261, 2275, 2281, 2291, 2293, 2359, 2659, 2699, 2766, 2806, 3026, 3036, 3038, 3056, 3076, 3086, 3096, 3211, 3215, 3374, 3487, 3519, 3646, 3678, 3715, 3739, 3789, 498, 517, 582, 596, 616, 651, 706, 723, 751, 768, 806, 831, 886, 913, 958, 989, 1013, 1094, 1118, 1173, 1197, 1306, 1308, 1310, 1313, 1320, 1323, 1330, 1333, 1340, 1343, 1350, 1358, 1361, 1365, 1370, 1374, 1376, 1380, 1383, 1385, 1388, 1392, 1394, 1868, 1876, 1908, 1940, 1948, 1956, 1972, 1988, 1996, 2020, 2028, 2060, 2068, 2108, 2140, 2148, 2156, 2180, 2186, 2190, 2198, 2202, 2870, 3906, 3942, 3978, 4076, 4086, 4122, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4199, 4203, 4434, 4438, 4439, 4441, 4444, 4449]
95, 441, [1, 3, 7, 8, 11, 12, 13, 17, 18, 25, 27, 28, 29, 30, 31, 32, 34, 35, 36, 37, 39, 40, 41, 42, 46, 48, 49, 50, 51, 52, 53, 54, 56, 57, 58, 59, 60, 61, 62, 63, 64, 67, 70, 72, 74, 75, 76, 77, 80, 81, 82, 84, 85, 86, 87, 91, 93, 94, 97, 98, 99, 102, 103, 104, 106, 107, 108, 109, 112, 115, 117, 119, 120, 121, 122, 125, 126, 127, 129, 130, 131, 132, 136, 138, 139, 141, 142, 143, 144, 147, 148, 151, 152, 153, 154, 157, 160, 162, 164, 165, 166, 167, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 252, 253, 255, 256, 257, 259, 261, 262, 263, 264, 265, 267, 268, 269, 273, 274, 275, 276, 277, 278, 279, 280, 281, 282, 284, 285, 286, 287, 288, 289, 290, 291, 292, 293, 294, 295, 296, 297, 298, 299, 303, 304, 305, 306, 307, 308, 309, 310, 311, 315, 316, 317, 318, 319, 320, 321, 322, 323, 324, 325, 326, 327, 328, 329, 333, 334, 335, 337, 338, 339, 340, 341, 345, 346, 347, 348, 349, 350, 351, 352, 353, 354, 355, 356, 357, 358, 359, 363, 364, 365, 366, 367, 368, 369, 370, 371, 375, 376, 377, 378, 379, 380, 381, 382, 383, 384, 385, 386, 387, 388, 389, 393, 394, 395, 396, 397, 398, 399, 400, 401, 405, 406, 407, 408, 410, 411, 412, 413, 414, 415, 416, 417, 418, 419, 423, 424, 425, 426, 428, 429, 430, 431, 435, 436, 437, 438, 440, 441, 442, 443, 444, 446, 447, 448, 449, 454, 455, 460, 461, 466, 467, 473, 478, 479, 485, 488, 491, 494, 2215, 2221, 2241, 2247, 2261, 2267, 2281, 2291, 2293, 2339, 2426, 2838, 2898, 3026, 3036, 3046, 3056, 3066, 3076, 3086, 3096, 3114, 3199, 3342, 3595, 3715, 3726, 3758, 3774, 3789, 495, 508, 527, 585, 626, 641, 652, 675, 716, 731, 742, 765, 806, 813, 832, 852, 962, 1021, 1213, 1229, 1237, 1306, 1308, 1310, 1313, 1320, 1323, 1330, 1333, 1340, 1343, 1350, 1357, 1359, 1362, 1365, 1369, 1374, 1376, 1380, 1384, 1388, 1392, 1394, 1868, 1908, 1948, 1988, 2004, 2028, 2044, 2068, 2084, 2108, 2124, 2148, 2164, 2186, 2190, 2194, 2198, 2202, 3863, 3893, 3935, 3965, 3977, 3986, 4007, 4037, 4049, 4058, 3862, 3896, 3898, 3931, 3934, 3968, 3970, 4003, 4006, 4040, 4042, 4075, 4078, 4112, 4114, 4147, 4184, 4187, 4188, 4191, 4193, 4195, 4196,

TABLE 2-continued

List of strands for producing the nucleic acid structures of FIG. 3E. The
individuals strands 0-4454 are designated as SEQ ID NOs. 6842-11296, respectively. See also
Table 15 of U.S. provisional application number 61/675,309, filed Jul. 24, 2012, incorporated
by reference herein.
Shape, total number of strands, [list of strands]

4197, 4199, 4200, 4203, 4434, 4439, 4444, 4449]
96, 426, [3, 8, 12, 13, 18, 25, 27, 30, 31, 32, 34, 35, 36, 37, 40, 41, 42, 48, 49, 51, 52, 53, 54, 55, 56, 57, 58, 59, 62, 63, 64, 67, 70, 72, 73, 74, 75, 76, 77, 79, 80, 81, 82, 84, 85, 86, 87, 91, 93, 94, 97, 98, 99, 102, 103, 104, 106, 107, 108, 109, 112, 115, 117, 119, 120, 121, 122, 125, 126, 127, 129, 130, 131, 132, 136, 138, 139, 142, 143, 144, 147, 148, 149, 151, 152, 153, 154, 157, 160, 162, 164, 165, 166, 167, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 249, 250, 251, 252, 253, 255, 256, 257, 259, 261, 262, 263, 267, 268, 269, 273, 274, 275, 277, 279, 280, 281, 282, 283, 284, 285, 286, 287, 288, 289, 290, 291, 292, 293, 297, 298, 299, 303, 304, 305, 306, 307, 308, 309, 310, 311, 312, 314, 315, 316, 317, 318, 319, 320, 321, 322, 323, 325, 327, 328, 329, 333, 334, 335, 336, 337, 338, 339, 340, 341, 345, 346, 347, 348, 349, 350, 351, 352, 353, 354, 355, 356, 357, 358, 359, 363, 364, 365, 366, 367, 368, 369, 370, 371, 375, 376, 377, 378, 379, 380, 381, 382, 383, 384, 385, 386, 387, 388, 389, 393, 394, 395, 396, 397, 398, 399, 400, 401, 405, 406, 407, 408, 410, 411, 412, 413, 414, 415, 416, 417, 418, 419, 423, 424, 425, 426, 428, 429, 430, 431, 435, 436, 437, 438, 440, 441, 442, 443, 444, 446, 447, 448, 449, 454, 455, 460, 461, 466, 467, 472, 473, 478, 479, 485, 488, 491, 494, 2215, 2221, 2235, 2241, 2247, 2261, 2275, 2281, 2291, 2293, 2339, 2407, 2518, 2539, 2838, 2898, 3026, 3036, 3046, 3056, 3066, 3076, 3086, 3096, 3199, 3247, 3375, 3422, 3595, 3715, 3726, 3758, 3774, 3789, 508, 517, 574, 588, 672, 675, 716, 731, 742, 765, 806, 813, 832, 852, 958, 974, 1038, 1061, 1213, 1229, 1237, 1306, 1308, 1310, 1313, 1320, 1323, 1330, 1333, 1340, 1343, 1350, 1358, 1362, 1365, 1370, 1374, 1376, 1380, 1384, 1388, 1392, 1394, 1868, 1876, 1900, 1908, 1940, 1948, 1988, 2028, 2044, 2068, 2084, 2108, 2124, 2148, 2164, 2186, 2190, 2194, 2198, 2202, 3870, 3921, 3935, 3977, 3986, 4007, 4037, 4049, 4058, 3862, 3896, 3898, 3931, 3934, 3968, 3970, 4003, 4006, 4040, 4042, 4075, 4078, 4112, 4114, 4147, 4184, 4187, 4191, 4193, 4195, 4196, 4199, 4203, 4434, 4439, 4444, 4449]
97, 435, [3, 7, 8, 13, 17, 18, 25, 27, 29, 30, 31, 32, 33, 34, 35, 36, 37, 39, 40, 41, 42, 46, 48, 49, 50, 51, 52, 53, 54, 55, 56, 57, 58, 59, 61, 62, 63, 64, 67, 70, 72, 75, 76, 77, 79, 80, 81, 82, 85, 86, 87, 93, 94, 97, 98, 99, 102, 103, 104, 107, 108, 109, 112, 115, 117, 119, 120, 121, 122, 124, 125, 126, 127, 130, 131, 132, 138, 139, 142, 143, 144, 147, 148, 149, 152, 153, 154, 157, 160, 162, 165, 166, 167, 170, 171, 172, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 253, 255, 256, 257, 258, 259, 261, 262, 263, 265, 267, 268, 269, 271, 273, 274, 275, 276, 278, 279, 280, 281, 282, 283, 284, 285, 286, 287, 288, 289, 290, 291, 292, 293, 294, 295, 296, 297, 298, 299, 300, 301, 302, 303, 304, 305, 309, 310, 311, 312, 313, 314, 315, 316, 317, 318, 320, 321, 322, 323, 324, 325, 326, 327, 328, 329, 330, 331, 332, 333, 334, 335, 339, 340, 341, 342, 344, 345, 346, 347, 351, 352, 353, 354, 355, 356, 357, 358, 359, 360, 361, 362, 363, 364, 365, 369, 370, 371, 372, 374, 375, 376, 377, 381, 382, 383, 384, 385, 386, 387, 388, 389, 390, 392, 393, 394, 395, 399, 400, 401, 405, 406, 407, 411, 412, 413, 414, 416, 417, 418, 419, 420, 422, 423, 424, 425, 429, 430, 431, 435, 436, 437, 441, 442, 443, 444, 446, 447, 448, 449, 454, 455, 460, 461, 466, 467, 472, 473, 478, 479, 485, 488, 491, 494, 2215, 2221, 2227, 2241, 2255, 2261, 2267, 2281, 2291, 2293, 2319, 2359, 2387, 2446, 2498, 3026, 3036, 3046, 3056, 3066, 3076, 3086, 3096, 3183, 3215, 3231, 3326, 3419, 3438, 3547, 3582, 3611, 3710, 3715, 3774, 3789, 498, 507, 518, 527, 582, 631, 643, 662, 697, 721, 732, 752, 842, 954, 962, 966, 1013, 1069, 1141, 1205, 1237, 1306, 1308, 1310, 1313, 1315, 1319, 1322, 1325, 1327, 1329, 1332, 1335, 1337, 1339, 1350, 1358, 1361, 1366, 1369, 1374, 1376, 1380, 1384, 1388, 1392, 1394, 1868, 1996, 2036, 2052, 2076, 2092, 2116, 2124, 2132, 2156, 2164, 2172, 2186, 2190, 2194, 2198, 2202, 2863, 3957, 3971, 3978, 3994, 4003, 4066, 3862, 3896, 3898, 3929, 3931, 3933, 3934, 3966, 3968, 3970, 4003, 4005, 4006, 4038, 4040, 4042, 4075, 4077, 4078, 4110, 4112, 4114, 4147, 4184, 4187, 4189, 4191, 4192, 4195, 4197, 4199, 4200, 4203, 4434, 4439, 4444, 4449]
98, 418, [1, 3, 7, 8, 13, 16, 18, 25, 27, 29, 30, 31, 32, 35, 36, 37, 39, 40, 41, 42, 48, 49, 51, 52, 53, 54, 56, 57, 58, 59, 62, 63, 64, 67, 70, 72, 75, 76, 77, 79, 80, 81, 82, 85, 86, 87, 93, 94, 96, 97, 98, 99, 100, 101, 102, 103, 104, 107, 108, 109, 112, 115, 117, 118, 119, 120, 121, 122, 124, 125, 126, 127, 129, 130, 131, 132, 136, 138, 139, 142, 143, 144, 147, 148, 149, 151, 152, 153, 154, 157, 160, 162, 165, 166, 167, 170, 171, 172, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 255, 256, 257, 261, 262, 263, 264, 267, 268, 269, 273, 274, 275, 276, 278, 279, 280, 281, 283, 285, 286, 287, 288, 289, 290, 291, 292, 293, 297, 298, 299, 303, 304, 305, 309, 310, 311, 312, 313, 314, 315, 316, 317, 318, 319, 320, 321, 322, 323, 327, 328, 329, 333, 334, 335, 339, 340, 341, 342, 343, 344, 345, 346, 347, 348, 349, 350, 351, 352, 353, 357, 358, 359, 363, 364, 365, 369, 370, 371, 372, 374, 375, 376, 377, 378, 379, 380, 381, 382, 383, 387, 388, 389, 393, 394, 395, 396, 397, 398, 399, 400, 401, 405, 406, 407, 408, 410, 411, 412, 413, 417, 418, 419, 423, 424, 425, 426, 428, 429, 430, 431, 435, 436, 437, 441, 442, 443, 444, 446, 447, 448, 449, 454, 455, 460, 461, 466, 467, 472, 473, 478, 479, 485, 488, 491, 494, 2215, 2221, 2241, 2255, 2261, 2275, 2281, 2293, 2298, 2427, 2446, 2698, 2766, 2838, 2898, 3026, 3036, 3046, 3056, 3066, 3076, 3086, 3096, 3114, 3138, 3194, 3199, 3263, 3294, 3326, 3482, 3487, 3582, 3610, 3615, 3678, 3715, 3726, 3774, 3789, 495, 525, 543, 551, 617, 685, 706, 751, 765, 777, 813, 824, 843, 852, 958, 982, 997, 1013, 1094, 1141, 1158, 1189, 1213, 1237, 1306, 1310, 1313, 1320, 1323, 1330, 1333, 1340, 1343, 1350, 1357, 1359, 1362, 1366, 1369, 1371, 1374, 1376, 1380, 1384, 1388, 1392, 1394, 1868, 1884, 1908, 1948, 1980, 1988, 1996, 2020, 2028, 2060, 2068, 2108, 2124, 2148, 2164, 2172, 2186, 2190, 2194, 2198, 2202, 3893, 3900, 3942, 3957, 4058, 3859, 3862, 3896, 3898, 3931, 3934, 3968, 3970, 4003, 4006, 4040, 4042, 4075, 4078, 4112, 4114, 4147, 4184, 4187, 4188, 4191, 4195, 4199, 4200, 4203, 4434, 4439, 4444, 4449]
99, 451, [3, 6, 7, 8, 11, 12, 13, 17, 18, 25, 27, 29, 30, 31, 32, 34, 35, 36, 37, 39, 40, 41, 42, 46, 48, 49, 52, 53, 54, 57, 58, 59, 62, 63, 64, 67, 70, 72, 75, 76, 77, 80, 81, 82, 84, 85, 86, 87, 91, 93, 94, 95, 96, 97, 98, 99, 101, 102, 103, 104, 107, 108, 109, 112, 115, 117, 118, 119, 120, 121, 122, 124, 125, 126, 127, 129, 130, 131, 132, 136, 138, 139, 142, 143, 144, 147, 148, 149, 151, 152, 153, 154, 157, 160, 162, 164, 165, 166, 167, 170, 171, 172, 174, 175, 176, 177, 181, 183, 184, 187, 188, 189, 192, 193, 194, 196, 197, 198, 199, 202, 205, 206, 209, 210, 211, 216, 219, 220, 221, 227, 230, 233, 236, 239, 243, 244, 245, 246, 249, 250, 251, 252, 255, 256, 257, 258, 259, 261, 262, 263, 265, 267, 268, 269, 273, 274, 275, 276, 277, 278, 279, 280, 281, 285, 286, 287, 291, 292, 293, 297, 298, 299, 303, 304, 305, 309, 310, 311, 315, 316, 317, 318, 319, 320, 321, 322, 323, 324, 325, 326, 327, 328, 329, 333, 334, 335, 336, 337, 338, 339, 340, 341, 343, 345, 346, 347, 349, 351, 352, 353, 357, 358, 359, 363, 364, 365, 366, 367, 368, 369, 370, 371, 372, 374, 375, 376, 377, 378, 379, 380, 381, 382, 383, 384, 385, 386, 387, 388, 389, 393, 394, 395, 396, 397, 398, 399, 400, 401, 405, 406, 407, 408, 409, 410, 411, 412, 413, 414, 415, 416, 417, 418, 419, 423, 424, 425, 426, 427, 428, 429, 430, 431, 435, 436, 437, 438, 439, 440, 441, 442, 443, 444, 445, 446, 447, 448, 449, 454, 455, 456, 458, 460, 461, 466, 467, 468, 470, 472, 473, 474, 476, 478, 479, 483, 485, 488, 491, 492, 494, 2215, 2221, 2227, 2241, 2247, 2261, 2267, 2281, 2291, 2293, 2318, 2338, 2359, 2607, 2627, 2698, 3018, 3036, 3056, 3066, 3076, 3078, 3096, 3215, 3262, 3278, 3423, 3439, 3582, 3715, 3755, 3789, 498, 527, 542, 582, 585, 652, 675, 707, 765, 806, 821, 832, 855, 896, 903, 922, 942, 973, 981, 1054, 1062, 1118, 1141, 1306, 1308, 1310, 1313, 1320, 1323, 1330, 1333, 1340, 1343, 1350, 1358, 1361, 1365, 1369, 1374, 1376, 1379, 1381, 1384, 1387, 1391, 1394, 1868, 1908, 1940, 1948, 1956, 1964, 1988, 2020, 2028, 2068, 2108, 2124, 2148, 2164, 2186, 2194, 3905, 3965, 4007, 4037, 4049, 4058, 4079, 4109, 4121, 4130, 3862, 3896, 3898, 3931, 3934, 3968, 3970, 4003, 4006, 4040, 4042, 4075, 4078, 4112, 4114, 4147, 4184, 4187, 4189, 4191, 4192, 4193, 4195, 4196, 4197, 4199, 4200, 4203, 4433, 4434, 4436, 4439, 4444, 4446, 4448, 4449, 4451]
100, 426, [1, 3, 6, 7, 8, 11, 12, 13, 16, 17, 18, 25, 27, 28, 29, 30, 31, 32, 34, 35, 36, 37, 39, 40, 41, 42, 48, 49, 52, 53, 54, 56, 57, 58, 59, 62, 63, 64, 67, 70, 72, 75, 76, 77, 79, 80, 81, 82, 85, 86, 87, 93, 94, 96, 97, 98, 99, 102, 103, 104, 107, 108, 109, 112, 115, 117, 120, 121, 122, 125, 126, 127, 129, 130, 131, 132, 136, 138, 139, 140, 141, 142, 143, 144, 145, 146, 147, 148, 149, 151, 152, 153, 154, 157, 160, 162, 164, 165, 166, 167, 169, 170, 171, 172, 174, 175, 176, 177, 183, 184, 187, 188, 189, 192, 193, 194, 197, 198, 199, 202, 206, 211, 216, 221, 227, 230, 233, 236, 239, 243, 244, 245, 246, 247, 249, 250, 251, 252, 253, 255, 256, 257, 258, 261, 262, 263, 264, 267, 268, 269, 273, 274, 275, 279, 280, 281, 285, 286, 287, 288, 289, 290, 291, 292, 293, 297, 298, 299, 303, 304, 305, 309, 310, 311, 312, 313, 314, 315, 316, 317, 321, 322, 323, 327, 328, 329, 333, 334, 335, 339, 340, 341, 342, 343, 344, 345, 346, 347, 351, 352, 353, 357, 358, 359, 363, 364, 365, 369, 370,

| | |
|---|---|
| | TABLE 2-continued |

List of strands for producing the nucleic acid structures of FIG. 3E. The individuals strands 0-4454 are designated as SEQ ID NOs. 6842-11296, respectively. See also Table 15 of U.S. provisional application number 61/675,309, filed Jul. 24, 2012, incorporated by reference herein.
Shape, total number of strands, [list of strands]

371, 375, 376, 377, 378, 379, 380, 381, 382, 383, 387, 388, 389, 393, 394, 395, 396, 397, 398, 399, 400, 401, 402, 403, 404, 405, 406, 407, 409, 411, 412, 413, 417, 418, 419, 423, 424, 425, 426, 428, 429, 430, 431, 432, 434, 435, 436, 437, 438, 440, 441, 442, 443, 444, 446, 447, 448, 449, 454, 455, 460, 461, 466, 467, 472, 473, 478, 479, 485, 488, 491, 494, 2215, 2221, 2227, 2241, 2247, 2261, 2267, 2281, 2293, 2298, 2338, 2358, 2446, 2498, 2606, 2807, 2838, 2858, 2878, 2898, 3026, 3036, 3046, 3056, 3066, 3076, 3086, 3096, 3138, 3246, 3262, 3294, 3326, 3438, 3502, 3599, 3610, 3615, 3715, 3726, 3742, 3758, 3774, 3789, 495, 543, 582, 605, 617, 643, 651, 685, 697, 751, 765, 813, 852, 989, 997, 1022, 1070, 1094, 1134, 1142, 1158, 1213, 1221, 1229, 1237, 1306, 1310, 1313, 1320, 1323, 1330, 1333, 1340, 1343, 1350, 1357, 1361, 1365, 1369, 1371, 1374, 1376, 1380, 1384, 1388, 1392, 1394, 1868, 1908, 1948, 1972, 1980, 1988, 1996, 2020, 2028, 2036, 2060, 2068, 2108, 2148, 2186, 2190, 2194, 2198, 2202, 4022, 3859, 3862, 3896, 3898, 3931, 3934, 3968, 3970, 4003, 4006, 4040, 4042, 4075, 4078, 4112, 4114, 4147, 4184, 4187, 4188, 4189, 4191, 4192, 4193, 4195, 4196, 4197, 4199, 4200, 4203, 4434, 4439, 4444, 4449]

EQUIVALENTS

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described to herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (12203 sequences)

SEQ ID NO: 1 - DNA, 16 bp, Artificial Sequence
  Synthetic polynucleotide
ccaggttaagtggctc

SEQ ID NO: 2 - DNA, 16 bp, Artificial Sequence
  Synthetic polynucleotide
aatcatactcacggtt

SEQ ID NO: 3 - DNA, 32 bp, Artificial Sequence
  Synthetic polynucleotide
aactgttgtgtcctatgtttacttagggatgg

SEQ ID NO: 4 - DNA, 32 bp, Artificial Sequence
  Synthetic polynucleotide
tacgaactcaacgcacgctcgggtagtctcaa

SEQ ID NO: 5 - DNA, 32 bp, Artificial Sequence
  Synthetic polynucleotide
gaagatagagagcataaattcgctaaaccgga

SEQ ID NO: 6 - DNA, 32 bp, Artificial Sequence
  Synthetic polynucleotide
aaagtatccgcatctcactcagtgatcgagta

SEQ ID NO: 7 - DNA, 32 bp, Artificial Sequence
  Synthetic polynucleotide
ttcatgtcgccttttcgaacggtgacacactt

SEQ ID NO: 8 - DNA, 32 bp, Artificial Sequence
  Synthetic polynucleotide
gtgttcattcagagtagcggaaatatggccgc

SEQ ID NO: 9 - DNA, 32 bp, Artificial Sequence
  Synthetic polynucleotide
ttcggtgcgcagcgggccgcctgtaacgctta

SEQ ID NO: 10 - DNA, 32 bp, Artificial Sequence
  Synthetic polynucleotide
atcagcccgggcttttgctaatacgctgagcg

SEQ ID NO: 11 - DNA, 32 bp, Artificial Sequence
  Synthetic polynucleotide
atgctgttgttgcggggtttctgaaccggaac

SEQ ID NO: 12 - DNA, 16 bp, Artificial Sequence
  Synthetic polynucleotide
ccgggctaatgaagcc

SEQ ID NO: 13 - DNA, 32 bp, Artificial Sequence
  Synthetic polynucleotide
gtgaccccagagactgtctgatgcaccgggag

SEQ ID NO: 14 - DNA, 16 bp, Artificial Sequence
  Synthetic polynucleotide
ccagccacttagctgt

SEQ ID NO: 15 - DNA, 16 bp, Artificial Sequence
  Synthetic polynucleotide
gtcagtgtgatcgcga

SEQ ID NO: 16 - DNA, 16 bp, Artificial Sequence
  Synthetic polynucleotide
gttccctctagctagg

SEQ ID NO: 17 - DNA, 32 bp, Artificial Sequence
  Synthetic polynucleotide
gtgatgccaaaagggtggatatggagctggaa

SEQ ID NO: 18 - DNA, 32 bp, Artificial Sequence
  Synthetic polynucleotide
cggctctgatttctagtgacctggtataatgg

SEQ ID NO: 19 - DNA, 32 bp, Artificial Sequence
  Synthetic polynucleotide
cggagctacctgacctcaatcatacgtcccac

SEQ ID NO: 20 - DNA, 32 bp, Artificial Sequence
  Synthetic polynucleotide
ggaaggattcatcccctttaagaatgatcgca

SEQ ID NO: 21 - DNA, 32 bp, Artificial Sequence
  Synthetic polynucleotide
cagtctttgagatgttgaacatcttttggttg

SEQ ID NO: 22 - DNA, 32 bp, Artificial Sequence
  Synthetic polynucleotide
gcgtaaagatctcgcattctggtgccaaaact

SEQ ID NO: 23 - DNA, 32 bp, Artificial Sequence
  Synthetic polynucleotide
gccgactcgttcaagcactattatctggctat

SEQ ID NO: 24 - DNA, 32 bp, Artificial Sequence
  Synthetic polynucleotide
aaaagatgtctgtcagcccaagcttagcataa

SEQ ID NO: 25 - DNA, 16 bp, Artificial Sequence
  Synthetic polynucleotide
gcggctggacgacccc

SEQ ID NO: 26 - DNA, 32 bp, Artificial Sequence
  Synthetic polynucleotide
gccgtgcgacgactgaccgtcgagccctgcgc

SEQ ID NO: 27 - DNA, 16 bp, Artificial Sequence
  Synthetic polynucleotide
gacaaacgcatatcct

SEQ ID NO: 28 - DNA, 32 bp, Artificial Sequence
  Synthetic polynucleotide
cggcccgccaaattaatagtcgattacgcttc

SEQ ID NO: 29 - DNA, 16 bp, Artificial Sequence
  Synthetic polynucleotide
gcctaaaggtccttcc

SEQ ID NO: 30 - DNA, 16 bp, Artificial Sequence
  Synthetic polynucleotide
acggtaatcgggggtg

SEQ ID NO: 31 - DNA, 32 bp, Artificial Sequence
  Synthetic polynucleotide
actccggcctccttggtatattagcttaccca

SEQ ID NO: 32 - DNA, 32 bp, Artificial Sequence
  Synthetic polynucleotide
ctcgcgtggcacgtctacgactcgtcgaacga

SEQ ID NO: 33 - DNA, 32 bp, Artificial Sequence
  Synthetic polynucleotide
ggactgttctacatagtgacttggacgaggtt

SEQ ID NO: 34 - DNA, 32 bp, Artificial Sequence
  Synthetic polynucleotide
tcactgggcgctatacaggaaactcgaggggc

SEQ ID NO: 35 - DNA, 32 bp, Artificial Sequence
  Synthetic polynucleotide
tccctgtctgtcgagcccagcgaccacttctg

SEQ ID NO: 36 - DNA, 32 bp, Artificial Sequence
  Synthetic polynucleotide
gagaaagatgcggtggcagtagttgtgattag

SEQ ID NO: 37 - DNA, 32 bp, Artificial Sequence
  Synthetic polynucleotide
cttgggggtgatatacctcactaaactccttc

SEQ ID NO: 38 - DNA, 32 bp, Artificial Sequence
  Synthetic polynucleotide
taatgtgactaagcgttaactccaaaggaaac

SEQ ID NO: 39 - DNA, 32 bp, Artificial Sequence
  Synthetic polynucleotide
cagctatcccatattcgatgtaagcggacatc

SEQ ID NO: 40 - DNA, 16 bp, Artificial Sequence
  Synthetic polynucleotide
tatgcgcccgatatcc

SEQ ID NO: 41 - DNA, 32 bp, Artificial Sequence
  Synthetic polynucleotide
gttcaaactagggggcttctgaccaaagctca

SEQ ID NO: 42 - DNA, 16 bp, Artificial Sequence
  Synthetic polynucleotide
tgagaattgtaaacag

SEQ ID NO: 43 - DNA, 16 bp, Artificial Sequence
  Synthetic polynucleotide
gaacagcttagagcag

SEQ ID NO: 44 - DNA, 16 bp, Artificial Sequence
  Synthetic polynucleotide
tcaagttcggatacgc

SEQ ID NO: 45 - DNA, 32 bp, Artificial Sequence
  Synthetic polynucleotide
tacctatggacggggatatgcgacaccatgat

SEQ ID NO: 46 - DNA, 32 bp, Artificial Sequence
  Synthetic polynucleotide
ccggatgagttatgaagatcgtcattgggata

SEQ ID NO: 47 - DNA, 32 bp, Artificial Sequence
  Synthetic polynucleotide
tacaatctcgaagtaaagcatagcaccctgcg

SEQ ID NO: 48 - DNA, 32 bp, Artificial Sequence
  Synthetic polynucleotide
aagatagggtcacagcagtaatacctctacct

SEQ ID NO: 49 - DNA, 32 bp, Artificial Sequence
  Synthetic polynucleotide
tgttggacgtaagcgtgaaataacgaccagaa

SEQ ID NO: 50 - DNA, 32 bp, Artificial Sequence
  Synthetic polynucleotide
agcacgaggattatcacgtgtacctcgaaata

SEQ ID NO: 51 - DNA, 32 bp, Artificial Sequence
  Synthetic polynucleotide
atcgttagtttctcgactgttccgaaacaggc

SEQ ID NO: 52 - DNA, 32 bp, Artificial Sequence
  Synthetic polynucleotide
agcggtagcctcccacttaacctatgccttgg

SEQ ID NO: 53 - DNA, 16 bp, Artificial Sequence
  Synthetic polynucleotide
taactgattttctcct

SEQ ID NO: 54 - DNA, 32 bp, Artificial Sequence
  Synthetic polynucleotide
ggttccgctagctgatctatggtccttaatat

SEQ ID NO: 55 - DNA, 16 bp, Artificial Sequence
  Synthetic polynucleotide
aaccctcggaggcaag

SEQ ID NO: 56 - DNA, 32 bp, Artificial Sequence
  Synthetic polynucleotide
gggagagggtgaaacaggccacctggctcggg

SEQ ID NO: 57 - DNA, 16 bp, Artificial Sequence
  Synthetic polynucleotide
gagtgccccctcggca

SEQ ID NO: 58 - DNA, 16 bp, Artificial Sequence
  Synthetic polynucleotide
gccgcctcggttatac

SEQ ID NO: 59 - DNA, 32 bp, Artificial Sequence
  Synthetic polynucleotide
tcgtcaagcctgctttccatagctaacccgat

SEQ ID NO: 60 - DNA, 32 bp, Artificial Sequence
  Synthetic polynucleotide
tgtgcattccacgtgagtcgtacttaaagcaa

SEQ ID NO: 61 - DNA, 32 bp, Artificial Sequence
  Synthetic polynucleotide
acgtgggagtgcccgagcgtctgaggtatggt

SEQ ID NO: 62 - DNA, 32 bp, Artificial Sequence
  Synthetic polynucleotide
ttacccactatgttgtctcaagtgctaacagt

SEQ ID NO: 63 - DNA, 32 bp, Artificial Sequence
  Synthetic polynucleotide
actaattatccataactgtgcacgtcagggat

SEQ ID NO: 64 - DNA, 32 bp, Artificial Sequence
  Synthetic polynucleotide
tctcaccggtggccgttgctacatcagtttct

SEQ ID NO: 65 - DNA, 32 bp, Artificial Sequence
  Synthetic polynucleotide
ttgcactcctggggaaactatacttacgcact

SEQ ID NO: 66 - DNA, 32 bp, Artificial Sequence
  Synthetic polynucleotide
ggtttggagggattaggcaattgctaggttgc

SEQ ID NO: 67 - DNA, 32 bp, Artificial Sequence
  Synthetic polynucleotide
attgtaggcacaatttttgattcgatcacata

SEQ ID NO: 68 - DNA, 16 bp, Artificial Sequence
  Synthetic polynucleotide
catgggcaataaagct

SEQ ID NO: 69 - DNA, 32 bp, Artificial Sequence
  Synthetic polynucleotide
gtagcctgaggcgcgcagctgcaccgtgtcac

SEQ ID NO: 70 - DNA, 16 bp, Artificial Sequence
  Synthetic polynucleotide
cttgatattgagggac

SEQ ID NO: 71 - DNA, 16 bp, Artificial Sequence
  Synthetic polynucleotide
acctcgtcattcggat

SEQ ID NO: 72 - DNA, 16 bp, Artificial Sequence
  Synthetic polynucleotide
aaaccatactgagggc

SEQ ID NO: 73 - DNA, 32 bp, Artificial Sequence
  Synthetic polynucleotide
agtgggcgagatcggctaatcattagtgctcc

SEQ ID NO: 74 - DNA, 32 bp, Artificial Sequence
  Synthetic polynucleotide
cttagttagttcatagttcattaggggcggaa

SEQ ID NO: 75 - DNA, 32 bp, Artificial Sequence
  Synthetic polynucleotide
atgggctggtgccccacgtacagtaaccaacc

SEQ ID NO: 76 - DNA, 32 bp, Artificial Sequence
  Synthetic polynucleotide
ggtgtacctgtgggtagggccgagcgctgggc

SEQ ID NO: 77 - DNA, 32 bp, Artificial Sequence
  Synthetic polynucleotide
ttacatgtgcaagtgaaatatatgacttggtc

SEQ ID NO: 78 - DNA, 32 bp, Artificial Sequence
  Synthetic polynucleotide
gaccagatctgctagaaaccaccaacatcctc

SEQ ID NO: 79 - DNA, 16 bp, Artificial Sequence
  Synthetic polynucleotide
gtatgatttttttttt

SEQ ID NO: 80 - DNA, 48 bp, Artificial Sequence
  Synthetic polynucleotide
ctatcttcataggacacaacagttaaccgtgaccagccgcgcgcaggg

SEQ ID NO: 81 - DNA, 48 bp, Artificial Sequence
  Synthetic polynucleotide
tttttttttccggtttagcgaatttatgctctcgcacggcttaatttg

SEQ ID NO: 82 - DNA, 48 bp, Artificial Sequence
  Synthetic polynucleotide
ccaggttaagtggctcaatcatactcacggttaactgttgtgtcctat

SEQ ID NO: 83 - DNA, 32 bp, Artificial Sequence
  Synthetic polynucleotide
gtttacttagggatggtacgaactcaacgcac

SEQ ID NO: 84 - DNA, 48 bp, Artificial Sequence
  Synthetic polynucleotide
gctcgggtagtctcaagaagatagagagcataaattcgctaaaccgga

SEQ ID NO: 85 - DNA, 32 bp, Artificial Sequence; identical to SEQ ID NO: 6
  Synthetic polynucleotide

SEQ ID NO: 86 - DNA, 16 bp, Artificial Sequence
  Synthetic polynucleotide
caccgttctttttttt

SEQ ID NO: 87 - DNA, 48 bp, Artificial Sequence
  Synthetic polynucleotide
acaggcgggtgcgttgagttcgtaaagtgtgtaaagactgtgcgagat

SEQ ID NO: 88 - DNA, 48 bp, Artificial Sequence
  Synthetic polynucleotide
tttttttttactcgatcactgagttaagcgttgagtcggcctgacaga

SEQ ID NO: 89 - DNA, 32 bp, Artificial Sequence; identical to SEQ ID NO: 7
  Synthetic polynucleotide

SEQ ID NO: 90 - DNA, 32 bp, Artificial Sequence; identical to SEQ ID NO: 8
  Synthetic polynucleotide

SEQ ID NO: 91 - DNA, 32 bp, Artificial Sequence; identical to SEQ ID NO: 9
  Synthetic polynucleotide

SEQ ID NO: 92 - DNA, 32 bp, Artificial Sequence; identical to SEQ ID NO: 10
  Synthetic polynucleotide

SEQ ID NO: 93 - DNA, 16 bp, Artificial Sequence
  Synthetic polynucleotide
tagcccggtttttttt

SEQ ID NO: 94 - DNA, 48 bp, Artificial Sequence
  Synthetic polynucleotide
gtggctgggcggccatatttccgcggcttcatgagggaacttccagct

SEQ ID NO: 95 - DNA, 48 bp, Artificial Sequence
  Synthetic polynucleotide
ttttttttcgctcagcgtattagcacagctaatagctccgggggatga

SEQ ID NO: 96 - DNA, 48 bp, Artificial Sequence
  Synthetic polynucleotide
atgctgttgttgcggggtttctgaaccggaacccgggctaatgaagcc

SEQ ID NO: 97 - DNA, 48 bp, Artificial Sequence
  Synthetic polynucleotide
gtgaccccagagactgtctgatgcaccgggagccagccacttagctgt

SEQ ID NO: 98 - DNA, 16 bp, Artificial Sequence
  Synthetic polynucleotide
gtcagtgtgatcgcga

SEQ ID NO: 99 - DNA, 48 bp, Artificial Sequence
  Synthetic polynucleotide
acactgacttttttttttttttttgttccggttcagaaaccccgcaac

SEQ ID NO: 100 - DNA, 32 bp, Artificial Sequence
  Synthetic polynucleotide
cagagccgtcgcgatccttacatcgaatatgg

SEQ ID NO: 101 - DNA, 48 bp, Artificial Sequence
  Synthetic polynucleotide
ccaggtcactagaaataacagcatctcccggtgcatcagacagtctct

SEQ ID NO: 102 - DNA, 32 bp, Artificial Sequence
  Synthetic polynucleotide
ttcttaaaccattataggtcagaagcccccta

SEQ ID NO: 103 - DNA, 32 bp, Artificial Sequence
  Synthetic polynucleotide
tttttttttgcgatcaggggtcactttttttt

SEQ ID NO: 104 - DNA, 32 bp, Artificial Sequence
  Synthetic polynucleotide
gttccctctagctagggtgatgccaaaagggt

SEQ ID NO: 105 - DNA, 48 bp, Artificial Sequence
  Synthetic polynucleotide
ggatatggagctggaacggctctgatttctagtgacctggtataatgg

SEQ ID NO: 106 - DNA, 32 bp, Artificial Sequence; identical to SEQ ID NO: 19
  Synthetic polynucleotide

SEQ ID NO: 107 - DNA, 32 bp, Artificial Sequence; identical to SEQ ID NO: 20
  Synthetic polynucleotide

SEQ ID NO: 108 - DNA, 48 bp, Artificial Sequence
  Synthetic polynucleotide
ggcatcacttttttttttttttttgaaaaggcgacatgaatactctga

SEQ ID NO: 109 - DNA, 32 bp, Artificial Sequence
  Synthetic polynucleotide
caccagaaacccttttgacagggaccaccgca

SEQ ID NO: 110 - DNA, 48 bp, Artificial Sequence
  Synthetic polynucleotide
tatgattgagttttggatgaacaccccgctgcgcaccgaaaaaagccc

SEQ ID NO: 111 - DNA, 32 bp, Artificial Sequence
  Synthetic polynucleotide
agcttggggtgggacgcccccaagacgcttag

SEQ ID NO: 112 - DNA, 32 bp, Artificial Sequence
  Synthetic polynucleotide
ttttttttttatgctagggctgattttttttt

SEQ ID NO: 113 - DNA, 32 bp, Artificial Sequence; identical to SEQ ID NO: 21
  Synthetic polynucleotide

SEQ ID NO: 114 - DNA, 32 bp, Artificial Sequence; identical to SEQ ID NO: 22
  Synthetic polynucleotide

SEQ ID NO: 115 - DNA, 32 bp, Artificial Sequence; identical to SEQ ID NO: 23
  Synthetic polynucleotide

SEQ ID NO: 116 - DNA, 32 bp, Artificial Sequence; identical to SEQ ID NO: 24
  Synthetic polynucleotide

SEQ ID NO: 117 - DNA, 48 bp, Artificial Sequence
  Synthetic polynucleotide
agatgttcttttttttttttttttgagccacttaacctggccatccct

SEQ ID NO: 118 - DNA, 32 bp, Artificial Sequence
  Synthetic polynucleotide
cgtttgtccaaccaaactttaggctgggtaag

SEQ ID NO: 119 - DNA, 48 bp, Artificial Sequence
  Synthetic polynucleotide
ataatagtaggatatgaagtaaacttgagactacccgagcgagatgcg

SEQ ID NO: 120 - DNA, 32 bp, Artificial Sequence
  Synthetic polynucleotide
atcgactaatagccagcgagtcgtgtatagcg

SEQ ID NO: 121 - DNA, 32 bp, Artificial Sequence
  Synthetic polynucleotide
ttttttttgaagcgtagatacttttttttttt

SEQ ID NO: 122 - DNA, 16 bp, Artificial Sequence
  Synthetic polynucleotide
gcggctggacgacccc

SEQ ID NO: 123 - DNA, 48 bp, Artificial Sequence
  Synthetic polynucleotide
gccgtgcgacgactgaccgtcgagccctgcgcgacaaacgcatatcct

SEQ ID NO: 124 - DNA, 32 bp, Artificial Sequence; identical to SEQ ID NO: 28
  Synthetic polynucleotide

SEQ ID NO: 125 - DNA, 32 bp, Artificial Sequence
  Synthetic polynucleotide
attaccgtttttttttttttttttggggtcgt

SEQ ID NO: 126 - DNA, 32 bp, Artificial Sequence
  Synthetic polynucleotide
gccggagtcacccccgatcagttaatattaag

SEQ ID NO: 127 - DNA, 32 bp, Artificial Sequence
  Synthetic polynucleotide
aacagtccccaaggagctcgacggtcagtcgt

SEQ ID NO: 128 - DNA, 32 bp, Artificial Sequence
  Synthetic polynucleotide
ccaagtcactatgtaggcggaacctgtttcac

SEQ ID NO: 129 - DNA, 32 bp, Artificial Sequence
  Synthetic polynucleotide
ttttttttaacctcgtgcgggccgtttttttt

SEQ ID NO: 130 - DNA, 48 bp, Artificial Sequence
  Synthetic polynucleotide
gcctaaaggtccttccacggtaatcgggggtgactccggcctccttgg

SEQ ID NO: 131 - DNA, 32 bp, Artificial Sequence
  Synthetic polynucleotide
tatattagcttacccactcgcgtggcacgtct

SEQ ID NO: 132 - DNA, 48 bp, Artificial Sequence
  Synthetic polynucleotide
acgactcgtcgaacgaggactgttctacatagtgacttggacgaggtt

SEQ ID NO: 133 - DNA, 32 bp, Artificial Sequence; identical to SEQ ID NO: 34
  Synthetic polynucleotide

SEQ ID NO: 134 - DNA, 32 bp, Artificial Sequence
  Synthetic polynucleotide
gtcgctggttttttttttttttttaacatctc

SEQ ID NO: 135 - DNA, 32 bp, Artificial Sequence
  Synthetic polynucleotide
cacgcgagcagaagtggtccaacatgataatc

SEQ ID NO: 136 - DNA, 32 bp, Artificial Sequence
  Synthetic polynucleotide
ttagtgagagacgtgcctttacgcgcttgaac

SEQ ID NO: 137 - DNA, 32 bp, Artificial Sequence
  Synthetic polynucleotide
agtttcctgaaggagtctaacgatgtgggagg

SEQ ID NO: 138 - DNA, 32 bp, Artificial Sequence
  Synthetic polynucleotide
ttttttttgcccctcgcatctttttttttttt

SEQ ID NO: 139 - DNA, 32 bp, Artificial Sequence; identical to SEQ ID NO: 35
  Synthetic polynucleotide

SEQ ID NO: 140 - DNA, 32 bp, Artificial Sequence; identical to SEQ ID NO: 36
  Synthetic polynucleotide

SEQ ID NO: 141 - DNA, 32 bp, Artificial Sequence; identical to SEQ ID NO: 37
  Synthetic polynucleotide

SEQ ID NO: 142 - DNA, 32 bp, Artificial Sequence; identical to SEQ ID NO: 38
  Synthetic polynucleotide

SEQ ID NO: 143 - DNA, 32 bp, Artificial Sequence
  Synthetic polynucleotide
ggcgcatattttttttttttttttcctagcta

SEQ ID NO: 144 - DNA, 32 bp, Artificial Sequence
  Synthetic polynucleotide
aactactgggatatcggaacttgaatcatggt

SEQ ID NO: 145 - DNA, 32 bp, Artificial Sequence
  Synthetic polynucleotide
aattctcactaatcacccatatccaggtcagg

SEQ ID NO: 146 - DNA, 32 bp, Artificial Sequence
  Synthetic polynucleotide
tggagttactgtttacagattgtagctgtgac

SEQ ID NO: 147 - DNA, 32 bp, Artificial Sequence
  Synthetic polynucleotide
ttttttttgtttccttatccttcctttttttt

SEQ ID NO: 148 - DNA, 48 bp, Artificial Sequence
  Synthetic polynucleotide
cagctatcccatattcgatgtaagcggacatctatgcgcccgatatcc

SEQ ID NO: 149 - DNA, 48 bp, Artificial Sequence
  Synthetic polynucleotide
gttcaaactagggggcttctgaccaaagctcatgagaattgtaaacag

SEQ ID NO: 150 - DNA, 16 bp, Artificial Sequence
  Synthetic polynucleotide
gaacagcttagagcag

SEQ ID NO: 151 - DNA, 32 bp, Artificial Sequence
  Synthetic polynucleotide
agctgttcttttttttttttttttgatgtccg

SEQ ID NO: 152 - DNA, 32 bp, Artificial Sequence
  Synthetic polynucleotide
tcatccggctgctctacgaatcaaaaattgtg

SEQ ID NO: 153 - DNA, 32 bp, Artificial Sequence
  Synthetic polynucleotide
tgacgatcttcataacgatagctgtgagcttt

SEQ ID NO: 154 - DNA, 32 bp, Artificial Sequence
  Synthetic polynucleotide
gtattacttatcccaagtgcagctgcgcgcct

SEQ ID NO: 155 - DNA, 32 bp, Artificial Sequence
  Synthetic polynucleotide
ttttttttaggtagaggtttgaactttttttt

SEQ ID NO: 156 - DNA, 32 bp, Artificial Sequence
  Synthetic polynucleotide
tcaagttcggatacgctacctatggacgggga

SEQ ID NO: 157 - DNA, 32 bp, Artificial Sequence
  Synthetic polynucleotide
cttgacacctttcaatttttagtaaacaccca

SEQ ID NO: 158 - DNA, 32 bp, Artificial Sequence
  Synthetic polynucleotide
acagagctgaacttcccatggtcgttctactg

SEQ ID NO: 159 - DNA, 16 bp, Artificial Sequence
  Synthetic polynucleotide
tcgtatgatcatagga

SEQ ID NO: 160 - DNA, 32 bp, Artificial Sequence
  Synthetic polynucleotide
tcaaactaaatacagcgtaccgccagttcttg

SEQ ID NO: 161 - DNA, 16 bp, Artificial Sequence
  Synthetic polynucleotide
tccttattggcgatcg

SEQ ID NO: 162 - DNA, 32 bp, Artificial Sequence
  Synthetic polynucleotide
tgcattccaatgtttgatggccgcgtggctta

SEQ ID NO: 163 - DNA, 16 bp, Artificial Sequence
  Synthetic polynucleotide
aagtaaactttttttt

SEQ ID NO: 164 - DNA, 32 bp, Artificial Sequence
  Synthetic polynucleotide
taacctggccatccctccagccgctcagtcgt

SEQ ID NO: 165 - DNA, 16 bp, Artificial Sequence
  Synthetic polynucleotide
agcgaattgagccact

SEQ ID NO: 166 - DNA, 32 bp, Artificial Sequence
  Synthetic polynucleotide
gtatgatttccggtttcgtttgtcttaatttg

SEQ ID NO: 167 - DNA, 16 bp, Artificial Sequence
  Synthetic polynucleotide
ttttttttaaccgtga

SEQ ID NO: 168 - DNA, 16 bp, Artificial Sequence
  Synthetic polynucleotide
caacagttgtgcgttg

SEQ ID NO: 169 - DNA, 16 bp, Artificial Sequence
  Synthetic polynucleotide
ctatcttcgagatgcg

SEQ ID NO: 170 - DNA, 16 bp, Artificial Sequence
  Synthetic polynucleotide
caccgttctttttttt

SEQ ID NO: 171 - DNA, 32 bp, Artificial Sequence
  Synthetic polynucleotide
acccgagcaagtgtgtaaagactgtgcgagat

SEQ ID NO: 172 - DNA, 16 bp, Artificial Sequence
  Synthetic polynucleotide
acaggcggttgagact

SEQ ID NO: 173 - DNA, 32 bp, Artificial Sequence
  Synthetic polynucleotide
cactgagttaagcgttgagtcggcctgacaga

SEQ ID NO: 174 - DNA, 16 bp, Artificial Sequence
  Synthetic polynucleotide
tttttttttactcgat

SEQ ID NO: 175 - DNA, 16 bp, Artificial Sequence
  Synthetic polynucleotide
gacatgaatactctga

SEQ ID NO: 176 - DNA, 16 bp, Artificial Sequence
  Synthetic polynucleotide
gcaccgaaaaaagccc

SEQ ID NO: 177 - DNA, 16 bp, Artificial Sequence
  Synthetic polynucleotide
tcagaaactttttttt

SEQ ID NO: 178 - DNA, 32 bp, Artificial Sequence
  Synthetic polynucleotide
atttccgcgttccggtggcatcacctagaaat

SEQ ID NO: 179 - DNA, 16 bp, Artificial Sequence
  Synthetic polynucleotide
gcatcagagcggccat

SEQ ID NO: 180 - DNA, 32 bp, Artificial Sequence
  Synthetic polynucleotide
gtattagcctcccggttagctccgggggatga

SEQ ID NO: 181 - DNA, 16 bp, Artificial Sequence
  Synthetic polynucleotide
ttttttttcgctcagc

SEQ ID NO: 182 - DNA, 16 bp, Artificial Sequence
  Synthetic polynucleotide
aacagcatggcttcat

SEQ ID NO: 183 - DNA, 16 bp, Artificial Sequence
  Synthetic polynucleotide
ggggtcacacagctaa

SEQ ID NO: 184 - DNA, 32 bp, Artificial Sequence
  Synthetic polynucleotide
acactgacttttttttttttttttcccgcaac

SEQ ID NO: 185 - DNA, 32 bp, Artificial Sequence
  Synthetic polynucleotide
ccaggtcatcgcgatcgatagctgggatatcg

SEQ ID NO: 186 - DNA, 32 bp, Artificial Sequence
  Synthetic polynucleotide
gagggaacccattatatagcccggcagtctct

SEQ ID NO: 187 - DNA, 32 bp, Artificial Sequence
  Synthetic polynucleotide
ttcttaaacctagctagtttgaacctgtttac

SEQ ID NO: 188 - DNA, 32 bp, Artificial Sequence
  Synthetic polynucleotide
tttttttttgcgatcagtggctggtttttttt

SEQ ID NO: 189 - DNA, 32 bp, Artificial Sequence
  Synthetic polynucleotide
ccatatccttttttttttttttttgaaaaggc

SEQ ID NO: 190 - DNA, 32 bp, Artificial Sequence
  Synthetic polynucleotide
caccagaattccagctgacagggaccaccgca

SEQ ID NO: 191 - DNA, 32 bp, Artificial Sequence
  Synthetic polynucleotide
tatgattgagttttggatgaacaccccgctgc

SEQ ID NO: 192 - DNA, 32 bp, Artificial Sequence; identical to SEQ ID NO: 111
  Synthetic polynucleotide

SEQ ID NO: 193 - DNA, 32 bp, Artificial Sequence; identical to SEQ ID NO: 112
  Synthetic polynucleotide

SEQ ID NO: 194 - DNA, 32 bp, Artificial Sequence
  Synthetic polynucleotide
agatgttcttttttttttttttttataggaca

SEQ ID NO: 195 - DNA, 32 bp, Artificial Sequence
  Synthetic polynucleotide
ctcgacggcaaccaaagccggagtagacgtgc

SEQ ID NO: 196 - DNA, 32 bp, Artificial Sequence
  Synthetic polynucleotide
ataatagtgcgcagggagttcgtatatgctct

SEQ ID NO: 197 - DNA, 32 bp, Artificial Sequence
  Synthetic polynucleotide
atcgactaatagccagaacagtccgtatagcg

SEQ ID NO: 198 - DNA, 32 bp, Artificial Sequence; identical to SEQ ID NO: 121
  Synthetic polynucleotide

SEQ ID NO: 199 - DNA, 32 bp, Artificial Sequence
  Synthetic polynucleotide
ctaatatattttttttttttttttggggtcgt

SEQ ID NO: 200 - DNA, 32 bp, Artificial Sequence
  Synthetic polynucleotide
ctttaggctgggtaagatcagttaatcagcta

SEQ ID NO: 201 - DNA, 32 bp, Artificial Sequence
  Synthetic polynucleotide
ccaagtcaggaaggaccgcacggcaggatatg

SEQ ID NO: 202 - DNA, 32 bp, Artificial Sequence
  Synthetic polynucleotide
attaccgtaacctcgtcgagggtttgtttcac

SEQ ID NO: 203 - DNA, 32 bp, Artificial Sequence
  Synthetic polynucleotide
ttttttttcacccccggcgggccgtttttttt

SEQ ID NO: 204 - DNA, 32 bp, Artificial Sequence; identical to SEQ ID NO: 134
  Synthetic polynucleotide

SEQ ID NO: 205 - DNA, 32 bp, Artificial Sequence
  Synthetic polynucleotide
cgagtcgtcagaagtggtccaacatgataatc

SEQ ID NO: 206 - DNA, 32 bp, Artificial Sequence
  Synthetic polynucleotide
ttagtgagtcgttcgactttacgcgcttgaac

SEQ ID NO: 207 - DNA, 32 bp, Artificial Sequence; identical to SEQ ID NO: 137
  Synthetic polynucleotide

SEQ ID NO: 208 - DNA, 32 bp, Artificial Sequence; identical to SEQ ID NO: 138
  Synthetic polynucleotide

SEQ ID NO: 209 - DNA, 32 bp, Artificial Sequence
  Synthetic polynucleotide
cttacatcttttttttttttttttaccctttt

SEQ ID NO: 210 - DNA, 32 bp, Artificial Sequence
  Synthetic polynucleotide
aactactggatgtccgcataggtattcataac

SEQ ID NO: 211 - DNA, 32 bp, Artificial Sequence
  Synthetic polynucleotide
ggtcagaactaatcaccagagccgaggtcagg

SEQ ID NO: 212 - DNA, 32 bp, Artificial Sequence
  Synthetic polynucleotide
tggagttatgagctttagattgtagctgtgac

SEQ ID NO: 213 - DNA, 32 bp, Artificial Sequence; identical to SEQ ID NO: 147
  Synthetic polynucleotide

SEQ ID NO: 214 - DNA, 32 bp, Artificial Sequence
  Synthetic polynucleotide
agctgttcttttttttttttttttgaatatgg

SEQ ID NO: 215 - DNA, 32 bp, Artificial Sequence
  Synthetic polynucleotide
tgacgatcctgctctacctacaatagctttat

SEQ ID NO: 216 - DNA, 32 bp, Artificial Sequence
  Synthetic polynucleotide
gaacttgatatcccaaggcgcatagcccccta

SEQ ID NO: 217 - DNA, 32 bp, Artificial Sequence
  Synthetic polynucleotide
gtattactgcgtatcccaggctacgtccctca

SEQ ID NO: 218 - DNA, 32 bp, Artificial Sequence
  Synthetic polynucleotide
ttttttttaggtagagaattctcatttttttt

SEQ ID NO: 219 - DNA, 32 bp, Artificial Sequence
  Synthetic polynucleotide
gtcgcatattttttttttttttttgctcgaca

SEQ ID NO: 220 - DNA, 32 bp, Artificial Sequence
  Synthetic polynucleotide
ggtacacgatcatggttaattagtacggccac

SEQ ID NO: 221 - DNA, 32 bp, Artificial Sequence
  Synthetic polynucleotide
gctatgcttatttcgatctttctcgtatatca

SEQ ID NO: 222 - DNA, 32 bp, Artificial Sequence
  Synthetic polynucleotide
taggttaacgcagggtgagtgcaactaatccc

SEQ ID NO: 223 - DNA, 32 bp, Artificial Sequence
  Synthetic polynucleotide
ttttttttccaaggcatcacattatttttttt

SEQ ID NO: 224 - DNA, 32 bp, Artificial Sequence
  Synthetic polynucleotide
gttatttcttttttttttttttttccaaggag

SEQ ID NO: 225 - DNA, 32 bp, Artificial Sequence
  Synthetic polynucleotide
gaccatagttctggtccttgacgatcacgtgg

SEQ ID NO: 226 - DNA, 48 bp, Artificial Sequence
  Synthetic polynucleotide
tatgcgacaccatgatccggatgagttatgaagatcgtcattgggata

SEQ ID NO: 227 - DNA, 32 bp, Artificial Sequence; identical to SEQ ID NO: 47
  Synthetic polynucleotide

SEQ ID NO: 228 - DNA, 32 bp, Artificial Sequence; identical to SEQ ID NO: 48
  Synthetic polynucleotide

SEQ ID NO: 229 - DNA, 32 bp, Artificial Sequence
  Synthetic polynucleotide
cataggtattttttttttttttttgctcgaca

SEQ ID NO: 230 - DNA, 32 bp, Artificial Sequence
  Synthetic polynucleotide
ggtacacgtccccgtctaattagtacggccac

SEQ ID NO: 231 - DNA, 32 bp, Artificial Sequence; identical to SEQ ID NO: 221
  Synthetic polynucleotide

SEQ ID NO: 232 - DNA, 32 bp, Artificial Sequence; identical to SEQ ID NO: 222
  Synthetic polynucleotide

SEQ ID NO: 233 - DNA, 32 bp, Artificial Sequence; identical to SEQ ID NO: 223
  Synthetic polynucleotide

SEQ ID NO: 234 - DNA, 32 bp, Artificial Sequence; identical to SEQ ID NO: 49
  Synthetic polynucleotide

SEQ ID NO: 235 - DNA, 32 bp, Artificial Sequence; identical to SEQ ID NO: 50
  Synthetic polynucleotide

SEQ ID NO: 236 - DNA, 32 bp, Artificial Sequence; identical to SEQ ID NO: 51
  Synthetic polynucleotide

SEQ ID NO: 237 - DNA, 32 bp, Artificial Sequence; identical to SEQ ID NO: 52
  Synthetic polynucleotide

SEQ ID NO: 238 - DNA, 32 bp, Artificial Sequence
  Synthetic polynucleotide
gttatttcttttttttttttttttggaaggac

SEQ ID NO: 239 - DNA, 32 bp, Artificial Sequence
  Synthetic polynucleotide
cgagggttttctggtcgggcactcatcgggtt

SEQ ID NO: 240 - DNA, 32 bp, Artificial Sequence
  Synthetic polynucleotide
cggaacagcttgcctcctaatatatcgttcga

SEQ ID NO: 241 - DNA, 32 bp, Artificial Sequence
  Synthetic polynucleotide
aggtggccgcctgtttagtacgacacaacata

SEQ ID NO: 242 - DNA, 32 bp, Artificial Sequence
  Synthetic polynucleotide
ttttttttcccgagcccccagtgatttttttt

SEQ ID NO: 243 - DNA, 16 bp, Artificial Sequence
  Synthetic polynucleotide
taactgattttctcct

SEQ ID NO: 244 - DNA, 48 bp, Artificial Sequence
  Synthetic polynucleotide
ggttccgctagctgatctatggtccttaatataaccctcggaggcaag

SEQ ID NO: 245 - DNA, 32 bp, Artificial Sequence; identical to SEQ ID NO: 56
  Synthetic polynucleotide

SEQ ID NO: 246 - DNA, 32 bp, Artificial Sequence
  Synthetic polynucleotide
gaggcggcttttttttttttttttaggagaaa

SEQ ID NO: 247 - DNA, 48 bp, Artificial Sequence
  Synthetic polynucleotide
cttgacgagtataacctcatacgacaagaactggcggtacgctgtatt

SEQ ID NO: 248 - DNA, 32 bp, Artificial Sequence
  Synthetic polynucleotide
tcccacgtaaagcagggaccatagatcagcta

SEQ ID NO: 249 - DNA, 48 bp, Artificial Sequence
  Synthetic polynucleotide
tcagacgctcgggcactagtttgacaaacattggaatgcatttttttt

SEQ ID NO: 250 - DNA, 32 bp, Artificial Sequence
  Synthetic polynucleotide
ttttttttaccatacccctctccctttttttt

SEQ ID NO: 251 - DNA, 48 bp, Artificial Sequence
  Synthetic polynucleotide
gagtgccccctcggcagccgcctcggttatactcgtcaagcctgcttt

SEQ ID NO: 252 - DNA, 32 bp, Artificial Sequence
  Synthetic polynucleotide
ccatagctaacccgattgtgcattccacgtga

SEQ ID NO: 253 - DNA, 48 bp, Artificial Sequence
  Synthetic polynucleotide
gtcgtacttaaagcaaacgtgggagtgcccgagcgtctgaggtatggt

SEQ ID NO: 254 - DNA, 32 bp, Artificial Sequence; identical to SEQ ID NO: 62
  Synthetic polynucleotide

SEQ ID NO: 255 - DNA, 32 bp, Artificial Sequence
  Synthetic polynucleotide
cgtgcacattttttttttttttttacgcttac

SEQ ID NO: 256 - DNA, 48 bp, Artificial Sequence
  Synthetic polynucleotide
aatgcacaatccctgaacatgtaatctagcagatctggtcattgaaag

SEQ ID NO: 257 - DNA, 32 bp, Artificial Sequence
  Synthetic polynucleotide
agtatagttcacgtggctcgtgcttcgagaaa

SEQ ID NO: 258 - DNA, 48 bp, Artificial Sequence
  Synthetic polynucleotide
cacttgagagtgcgtagtgtcaagggaagttcagctctgttttttttt

SEQ ID NO: 259 - DNA, 32 bp, Artificial Sequence
  Synthetic polynucleotide
ttttttttactgttagctaccgcttttttttt

SEQ ID NO: 260 - DNA, 32 bp, Artificial Sequence; identical to SEQ ID NO: 63
  Synthetic polynucleotide

SEQ ID NO: 261 - DNA, 32 bp, Artificial Sequence; identical to SEQ ID NO: 64
  Synthetic polynucleotide

SEQ ID NO: 262 - DNA, 32 bp, Artificial Sequence; identical to SEQ ID NO: 65
  Synthetic polynucleotide

SEQ ID NO: 263 - DNA, 32 bp, Artificial Sequence; identical to SEQ ID NO: 66
  Synthetic polynucleotide

SEQ ID NO: 264 - DNA, 32 bp, Artificial Sequence
  Synthetic polynucleotide
tgcccatgttttttttttttttttgcgtatcc

SEQ ID NO: 265 - DNA, 48 bp, Artificial Sequence
  Synthetic polynucleotide
atgtagcaagctttattatggtttggagcactaatgattatggggcac

SEQ ID NO: 266 - DNA, 32 bp, Artificial Sequence
  Synthetic polynucleotide
atatcaagagaaactggtcgcatattacttcg

SEQ ID NO: 267 - DNA, 48 bp, Artificial Sequence
  Synthetic polynucleotide
gcaattgcgtccctcacagcccattacccacaggtacacctttttttt

SEQ ID NO: 268 - DNA, 32 bp, Artificial Sequence
  Synthetic polynucleotide
ttttttttgcaacctacctatctttttttttt

SEQ ID NO: 269 - DNA, 48 bp, Artificial Sequence
  Synthetic polynucleotide
attgtaggcacaatttttgattcgatcacatacatgggcaataaagct

SEQ ID NO: 270 - DNA, 48 bp, Artificial Sequence
  Synthetic polynucleotide
gtagcctgaggcgcgcagctgcaccgtgtcaccttgatattgagggac

SEQ ID NO: 271 - DNA, 16 bp, Artificial Sequence
  Synthetic polynucleotide
acctcgtcattcggat

SEQ ID NO: 272 - DNA, 48 bp, Artificial Sequence
  Synthetic polynucleotide
taactaagatccgaatgacgaggttttttttttttttttttatgtgat

SEQ ID NO: 273 - DNA, 48 bp, Artificial Sequence
  Synthetic polynucleotide
ctcggcccttccgcccctaatgaactatgaaccctacaatgtgacacg

SEQ ID NO: 274 - DNA, 32 bp, Artificial Sequence
  Synthetic polynucleotide
ttttttttgcccagcgcaggctactttttttt

SEQ ID NO: 275 - DNA, 16 bp, Artificial Sequence
  Synthetic polynucleotide
ttttttttgccctcag

SEQ ID NO: 276 - DNA, 32 bp, Artificial Sequence
  Synthetic polynucleotide
aaaccatactgagggcagtgggcgagatcggc

SEQ ID NO: 277 - DNA, 48 bp, Artificial Sequence
  Synthetic polynucleotide
taatcattagtgctcccttagttagttcatagttcattaggggcggaa

SEQ ID NO: 278 - DNA, 32 bp, Artificial Sequence; identical to SEQ ID NO: 75
  Synthetic polynucleotide

SEQ ID NO: 279 - DNA, 32 bp, Artificial Sequence; identical to SEQ ID NO: 76
  Synthetic polynucleotide

SEQ ID NO: 280 - DNA, 48 bp, Artificial Sequence
  Synthetic polynucleotide
tggtggttgccgatctcgcccactttttttttttttttttgttatgga

SEQ ID NO: 281 - DNA, 48 bp, Artificial Sequence
  Synthetic polynucleotide
cgaccatgggttggttactgtacggaggatgtcggtgagattccccag

SEQ ID NO: 282 - DNA, 32 bp, Artificial Sequence
  Synthetic polynucleotide
ttttttttcagtagaatccaaacctttttttt

SEQ ID NO: 283 - DNA, 16 bp, Artificial Sequence
  Synthetic polynucleotide
tttttttttcacttgc

SEQ ID NO: 284 - DNA, 32 bp, Artificial Sequence; identical to SEQ ID NO: 77
  Synthetic polynucleotide

SEQ ID NO: 285 - DNA, 32 bp, Artificial Sequence; identical to SEQ ID NO: 78
  Synthetic polynucleotide

SEQ ID NO: 286 - DNA, 32 bp, Artificial Sequence; identical to SEQ ID NO: 157
  Synthetic polynucleotide

SEQ ID NO: 287 - DNA, 32 bp, Artificial Sequence; identical to SEQ ID NO: 158
  Synthetic polynucleotide

SEQ ID NO: 288 - DNA, 48 bp, Artificial Sequence
  Synthetic polynucleotide
aataaggagaccaagtcatatatttttttttttttttttttgccgagg

SEQ ID NO: 289 - DNA, 48 bp, Artificial Sequence
  Synthetic polynucleotide
gcggccattgggtgtttactaaaacgatcgccagctatggttgcttta

SEQ ID NO: 290 - DNA, 32 bp, Artificial Sequence
  Synthetic polynucleotide
tttttttttaagccacgtgggtaatttttttt

SEQ ID NO: 291 - DNA, 16 bp, Artificial Sequence
  Synthetic polynucleotide
tttttttttcctatga

SEQ ID NO: 292 - DNA, 16 bp, Artificial Sequence
  Synthetic polynucleotide
tcgtatgatcatagga

SEQ ID NO: 293 - DNA, 48 bp, Artificial Sequence
  Synthetic polynucleotide
tcaaactaaatacagcgtaccgccagttcttgtccttattggcgatcg

SEQ ID NO: 294 - DNA, 32 bp, Artificial Sequence; identical to SEQ ID NO: 162
  Synthetic polynucleotide

SEQ ID NO: 295 - DNA, 32 bp, Artificial Sequence
  Synthetic polynucleotide
cggaacagatattaagcacgcgagctatgtag

SEQ ID NO: 296 - DNA, 32 bp, Artificial Sequence
  Synthetic polynucleotide
aggtggccgcctgttttcccacgtacaacata

SEQ ID NO: 297 - DNA, 32 bp, Artificial Sequence; identical to SEQ ID NO: 242
  Synthetic polynucleotide

SEQ ID NO: 298 - DNA, 32 bp, Artificial Sequence
  Synthetic polynucleotide
agctatggttttttttttttttttaggagaaa

SEQ ID NO: 299 - DNA, 32 bp, Artificial Sequence
  Synthetic polynucleotide
gggcactcatcgggtttcatacgagctgtatt

SEQ ID NO: 300 - DNA, 32 bp, Artificial Sequence
  Synthetic polynucleotide
tcagacgctgccgagggcggaacccttgcctc

SEQ ID NO: 301 - DNA, 32 bp, Artificial Sequence
  Synthetic polynucleotide
gaggcggcaccataccaataaggacaaacatt

SEQ ID NO: 302 - DNA, 32 bp, Artificial Sequence
  Synthetic polynucleotide
ttttttttgtataacccctctccctttttttt

SEQ ID NO: 303 - DNA, 32 bp, Artificial Sequence; identical to SEQ ID NO: 255
  Synthetic polynucleotide

SEQ ID NO: 304 - DNA, 32 bp, Artificial Sequence
  Synthetic polynucleotide
agtacgacatccctgaacatgtaatctagcag

SEQ ID NO: 305 - DNA, 32 bp, Artificial Sequence
  Synthetic polynucleotide
agtatagtttgctttactcgtgcttcgagaaa

SEQ ID NO: 306 - DNA, 32 bp, Artificial Sequence
  Synthetic polynucleotide
cacttgagagtgcgtagtgtcaagggaagttc

SEQ ID NO: 307 - DNA, 32 bp, Artificial Sequence; identical to SEQ ID NO: 259
  Synthetic polynucleotide

SEQ ID NO: 308 - DNA, 32 bp, Artificial Sequence
  Synthetic polynucleotide
cgaatcaatttttttttttttttttccccgtc

SEQ ID NO: 309 - DNA, 32 bp, Artificial Sequence
  Synthetic polynucleotide
atgtagcatatgtgatcgcccactctatgaac

SEQ ID NO: 310 - DNA, 32 bp, Artificial Sequence
  Synthetic polynucleotide
gtgcagctagaaactgtcatccggttacttcg

SEQ ID NO: 311 - DNA, 32 bp, Artificial Sequence
  Synthetic polynucleotide
gcaattgcgtgacacgcagcccattacccaca

SEQ ID NO: 312 - DNA, 32 bp, Artificial Sequence; identical to SEQ ID NO: 268
  Synthetic polynucleotide

SEQ ID NO: 313 - DNA, 32 bp, Artificial Sequence
  Synthetic polynucleotide
gacgaggtttttttttttttttttaaattgtg

SEQ ID NO: 314 - DNA, 16 bp, Artificial Sequence
  Synthetic polynucleotide
ctaatgaaatccgaat

SEQ ID NO: 315 - DNA, 32 bp, Artificial Sequence
  Synthetic polynucleotide
tatggtttttccgccctgcccatggcgcgcct

SEQ ID NO: 316 - DNA, 16 bp, Artificial Sequence
  Synthetic polynucleotide
ctcggcccgccctcag

SEQ ID NO: 317 - DNA, 32 bp, Artificial Sequence
  Synthetic polynucleotide
ttttttttgcccagcgatatcaagtttttttt

SEQ ID NO: 318 - DNA, 16 bp, Artificial Sequence
  Synthetic polynucleotide
ttttttttgccgatct

SEQ ID NO: 319 - DNA, 16 bp, Artificial Sequence
  Synthetic polynucleotide
taactaagtggggcac

SEQ ID NO: 320 - DNA, 16 bp, Artificial Sequence
  Synthetic polynucleotide
ggtacacctttttttt

SEQ ID NO: 321 - DNA, 32 bp, Artificial Sequence
  Synthetic polynucleotide
aatgattattttttttttttttttgttatgga

SEQ ID NO: 322 - DNA, 16 bp, Artificial Sequence
  Synthetic polynucleotide
tggtggttggagcact

SEQ ID NO: 323 - DNA, 32 bp, Artificial Sequence
  Synthetic polynucleotide
actgtacggaggatgtcggtgagattccccag

SEQ ID NO: 324 - DNA, 16 bp, Artificial Sequence
  Synthetic polynucleotide
cgaccatgggttggtt

SEQ ID NO: 325 - DNA, 32 bp, Artificial Sequence; identical to SEQ ID NO: 282
  Synthetic polynucleotide

SEQ ID NO: 326 - DNA, 16 bp, Artificial Sequence
  Synthetic polynucleotide
tttttttttcacttgc

SEQ ID NO: 327 - DNA, 16 bp, Artificial Sequence
  Synthetic polynucleotide
atctggtcattgaaag

SEQ ID NO: 328 - DNA, 16 bp, Artificial Sequence
  Synthetic polynucleotide
agctctgttttttttt

SEQ ID NO: 329 - DNA, 32 bp, Artificial Sequence
  Synthetic polynucleotide
catatattttttttttttttttttaaagcagg

SEQ ID NO: 330 - DNA, 16 bp, Artificial Sequence
  Synthetic polynucleotide
ggcggtacgaccaagt

SEQ ID NO: 331 - DNA, 32 bp, Artificial Sequence
  Synthetic polynucleotide
tactaaaacaagaactaatgcacatcgggcac

SEQ ID NO: 332 - DNA, 16 bp, Artificial Sequence
  Synthetic polynucleotide
gcggccattgggtgtt

SEQ ID NO: 333 - DNA, 32 bp, Artificial Sequence; identical to SEQ ID NO: 290
  Synthetic polynucleotide

SEQ ID NO: 334 - DNA, 16 bp, Artificial Sequence
  Synthetic polynucleotide
tttttttttcctatga

SEQ ID NO: 335 - DNA, 16 bp, Artificial Sequence
  Synthetic polynucleotide
tagtttgacgatcgcc

SEQ ID NO: 336 - DNA, 16 bp, Artificial Sequence
  Synthetic polynucleotide
ggaatgcatttttttt

SEQ ID NO: 337 - DNA, 48 bp, Artificial Sequence; identical to SEQ ID NO: 82
  Synthetic polynucleotide

SEQ ID NO: 338 - DNA, 48 bp, Artificial Sequence; identical to SEQ ID NO: 84
  Synthetic polynucleotide

SEQ ID NO: 339 - DNA, 32 bp, Artificial Sequence; identical to SEQ ID NO: 83
  Synthetic polynucleotide

SEQ ID NO: 340 - DNA, 32 bp, Artificial Sequence; identical to SEQ ID NO: 6
  Synthetic polynucleotide

SEQ ID NO: 341 - DNA, 32 bp, Artificial Sequence; identical to SEQ ID NO: 7
  Synthetic polynucleotide

SEQ ID NO: 342 - DNA, 32 bp, Artificial Sequence; identical to SEQ ID NO: 9
  Synthetic polynucleotide

SEQ ID NO: 343 - DNA, 32 bp, Artificial Sequence; identical to SEQ ID NO: 8
  Synthetic polynucleotide

SEQ ID NO: 344 - DNA, 32 bp, Artificial Sequence; identical to SEQ ID NO: 10
  Synthetic polynucleotide

SEQ ID NO: 345 - DNA, 48 bp, Artificial Sequence; identical to SEQ ID NO: 96
  Synthetic polynucleotide

SEQ ID NO: 346 - DNA, 48 bp, Artificial Sequence; identical to SEQ ID NO: 97
  Synthetic polynucleotide

SEQ ID NO: 347 - DNA, 16 bp, Artificial Sequence
  Synthetic polynucleotide
tgacctggtataatgg

SEQ ID NO: 348 - DNA, 32 bp, Artificial Sequence
  Synthetic polynucleotide
gtcagtgtgatcgcgagttccctctagctagg

SEQ ID NO: 349 - DNA, 48 bp, Artificial Sequence
  Synthetic polynucleotide
gtgatgccaaaagggtggatatggagctggaacggctctgatttctag

SEQ ID NO: 350 - DNA, 32 bp, Artificial Sequence; identical to SEQ ID NO: 20
  Synthetic polynucleotide

SEQ ID NO: 351 - DNA, 32 bp, Artificial Sequence; identical to SEQ ID NO: 22
  Synthetic polynucleotide

SEQ ID NO: 352 - DNA, 32 bp, Artificial Sequence; identical to SEQ ID NO: 19
  Synthetic polynucleotide

SEQ ID NO: 353 - DNA, 32 bp, Artificial Sequence; identical to SEQ ID NO: 21
  Synthetic polynucleotide

SEQ ID NO: 354 - DNA, 32 bp, Artificial Sequence; identical to SEQ ID NO: 24
  Synthetic polynucleotide

SEQ ID NO: 355 - DNA, 32 bp, Artificial Sequence
  Synthetic polynucleotide
gacaaacgcatatcctcggcccgccaaattaa

SEQ ID NO: 356 - DNA, 32 bp, Artificial Sequence; identical to SEQ ID NO: 23
  Synthetic polynucleotide

SEQ ID NO: 357 - DNA, 48 bp, Artificial Sequence
  Synthetic polynucleotide
gcggctggacgaccccgccgtgcgacgactgaccgtcgagccctgcgc

SEQ ID NO: 358 - DNA, 16 bp, Artificial Sequence
  Synthetic polynucleotide
tagtcgattacgcttc

SEQ ID NO: 359 - DNA, 48 bp, Artificial Sequence; identical to SEQ ID NO: 130
  Synthetic polynucleotide

SEQ ID NO: 360 - DNA, 48 bp, Artificial Sequence; identical to SEQ ID NO: 132
  Synthetic polynucleotide

SEQ ID NO: 361 - DNA, 32 bp, Artificial Sequence; identical to SEQ ID NO: 131
  Synthetic polynucleotide

SEQ ID NO: 362 - DNA, 32 bp, Artificial Sequence; identical to SEQ ID NO: 34
  Synthetic polynucleotide

SEQ ID NO: 363 - DNA, 32 bp, Artificial Sequence; identical to SEQ ID NO: 35
  Synthetic polynucleotide

SEQ ID NO: 364 - DNA, 32 bp, Artificial Sequence; identical to SEQ ID NO: 37
  Synthetic polynucleotide

SEQ ID NO: 365 - DNA, 32 bp, Artificial Sequence; identical to SEQ ID NO: 36
  Synthetic polynucleotide

SEQ ID NO: 366 - DNA, 32 bp, Artificial Sequence; identical to SEQ ID NO: 38
  Synthetic polynucleotide

SEQ ID NO: 367 - DNA, 48 bp, Artificial Sequence; identical to SEQ ID NO: 148
  Synthetic polynucleotide

SEQ ID NO: 368 - DNA, 48 bp, Artificial Sequence; identical to SEQ ID NO: 149
  Synthetic polynucleotide

SEQ ID NO: 369 - DNA, 16 bp, Artificial Sequence
  Synthetic polynucleotide
gatcgtcattgggata

SEQ ID NO: 370 - DNA, 32 bp, Artificial Sequence
  Synthetic polynucleotide
gaacagcttagagcagtcaagttcggatacgc

SEQ ID NO: 371 - DNA, 48 bp, Artificial Sequence
  Synthetic polynucleotide
tacctatggacggggatatgcgacaccatgatccggatgagttatgaa

SEQ ID NO: 372 - DNA, 32 bp, Artificial Sequence; identical to SEQ ID NO: 48
  Synthetic polynucleotide

SEQ ID NO: 373 - DNA, 32 bp, Artificial Sequence; identical to SEQ ID NO: 50
  Synthetic polynucleotide

SEQ ID NO: 374 - DNA, 32 bp, Artificial Sequence; identical to SEQ ID NO: 47
  Synthetic polynucleotide

SEQ ID NO: 375 - DNA, 32 bp, Artificial Sequence; identical to SEQ ID NO: 49
  Synthetic polynucleotide

SEQ ID NO: 376 - DNA, 32 bp, Artificial Sequence; identical to SEQ ID NO: 52
  Synthetic polynucleotide

SEQ ID NO: 377 - DNA, 32 bp, Artificial Sequence
  Synthetic polynucleotide
aaccctcggaggcaaggggagagggtgaaaca

SEQ ID NO: 378 - DNA, 32 bp, Artificial Sequence; identical to SEQ ID NO: 51
  Synthetic polynucleotide

SEQ ID NO: 379 - DNA, 48 bp, Artificial Sequence
  Synthetic polynucleotide
taactgattttctcctggttccgctagctgatctatggtccttaatat

SEQ ID NO: 380 - DNA, 16 bp, Artificial Sequence
  Synthetic polynucleotide
ggccacctggctcggg

SEQ ID NO: 381 - DNA, 48 bp, Artificial Sequence; identical to SEQ ID NO: 251
  Synthetic polynucleotide

SEQ ID NO: 382 - DNA, 48 bp, Artificial Sequence; identical to SEQ ID NO: 253
  Synthetic polynucleotide

SEQ ID NO: 383 - DNA, 32 bp, Artificial Sequence; identical to SEQ ID NO: 252
  Synthetic polynucleotide

SEQ ID NO: 384 - DNA, 32 bp, Artificial Sequence; identical to SEQ ID NO: 62
  Synthetic polynucleotide

SEQ ID NO: 385 - DNA, 32 bp, Artificial Sequence; identical to SEQ ID NO: 63
  Synthetic polynucleotide

SEQ ID NO: 386 - DNA, 32 bp, Artificial Sequence; identical to SEQ ID NO: 65
  Synthetic polynucleotide

SEQ ID NO: 387 - DNA, 32 bp, Artificial Sequence; identical to SEQ ID NO: 64
  Synthetic polynucleotide

SEQ ID NO: 388 - DNA, 32 bp, Artificial Sequence; identical to SEQ ID NO: 66
  Synthetic polynucleotide

SEQ ID NO: 389 - DNA, 48 bp, Artificial Sequence; identical to SEQ ID NO: 269
  Synthetic polynucleotide

SEQ ID NO: 390 - DNA, 48 bp, Artificial Sequence; identical to SEQ ID NO: 270
  Synthetic polynucleotide

SEQ ID NO: 391 - DNA, 16 bp, Artificial Sequence
  Synthetic polynucleotide
ttcattaggggcggaa

SEQ ID NO: 392 - DNA, 32 bp, Artificial Sequence
  Synthetic polynucleotide
acctcgtcattcggataaaccatactgagggc

SEQ ID NO: 393 - DNA, 48 bp, Artificial Sequence
  Synthetic polynucleotide
agtgggcgagatcggctaatcattagtgctcccttagttagttcatag

SEQ ID NO: 394 - DNA, 32 bp, Artificial Sequence; identical to SEQ ID NO: 76
  Synthetic polynucleotide

SEQ ID NO: 395 - DNA, 32 bp, Artificial Sequence; identical to SEQ ID NO: 78
  Synthetic polynucleotide

SEQ ID NO: 396 - DNA, 32 bp, Artificial Sequence; identical to SEQ ID NO: 75
  Synthetic polynucleotide

SEQ ID NO: 397 - DNA, 32 bp, Artificial Sequence; identical to SEQ ID NO: 77
  Synthetic polynucleotide

SEQ ID NO: 398 - DNA, 32 bp, Artificial Sequence; identical to SEQ ID NO: 158
  Synthetic polynucleotide

SEQ ID NO: 399 - DNA, 32 bp, Artificial Sequence
  Synthetic polynucleotide
tccttattggcgatcgtgcattccaatgtttg

SEQ ID NO: 400 - DNA, 32 bp, Artificial Sequence; identical to SEQ ID NO: 157
  Synthetic polynucleotide

SEQ ID NO: 401 - DNA, 48 bp, Artificial Sequence
  Synthetic polynucleotide
tcgtatgatcataggatcaaactaaatacagcgtaccgccagttcttg

SEQ ID NO: 402 - DNA, 16 bp, Artificial Sequence
  Synthetic polynucleotide
atggccgcgtggctta

SEQ ID NO: 403 - DNA, 48 bp, Artificial Sequence
  Synthetic polynucleotide
ttaagacggccggtgtaaccacataaagtcgtccgcctccggtagtca

SEQ ID NO: 404 - DNA, 48 bp, Artificial Sequence
  Synthetic polynucleotide
gacaaaaacagatttgtaccggggtgaacagcacgtgcggcttctcct

SEQ ID NO: 405 - DNA, 32 bp, Artificial Sequence
  Synthetic polynucleotide
acgcggaacgtaatggcagaaagtctataccc

SEQ ID NO: 406 - DNA, 32 bp, Artificial Sequence
  Synthetic polynucleotide
gtatcgccttgtgtattatactcttgcggggg

SEQ ID NO: 407 - DNA, 32 bp, Artificial Sequence
  Synthetic polynucleotide
ggtcgagcgctccactgtagtggccggccatc

SEQ ID NO: 408 - DNA, 32 bp, Artificial Sequence
  Synthetic polynucleotide
gctacctccgatacgcgaaccagaaccattta

SEQ ID NO: 409 - DNA, 32 bp, Artificial Sequence
  Synthetic polynucleotide
gtggactagaaagcgccggcaatctgaatatc

SEQ ID NO: 410 - DNA, 32 bp, Artificial Sequence
  Synthetic polynucleotide
agagtaggggcagtgctcagccaaacagtggg

SEQ ID NO: 411 - DNA, 48 bp, Artificial Sequence
  Synthetic polynucleotide
acatctcggaaaggtgtcccaagtgcaagtaaaaaaggaattatgaga

SEQ ID NO: 412 - DNA, 48 bp, Artificial Sequence
  Synthetic polynucleotide
tcatgtgggatcctaaagtttctggtagacctcgtaggctagagcggt

SEQ ID NO: 413 - DNA, 16 bp, Artificial Sequence
  Synthetic polynucleotide
cgttgcgaattttcgc

SEQ ID NO: 414 - DNA, 32 bp, Artificial Sequence
  Synthetic polynucleotide
gatatccacggtacattcgtttactgcacgga

SEQ ID NO: 415 - DNA, 48 bp, Artificial Sequence
  Synthetic polynucleotide
acgagagtgctggcataagcaagagaaacctaacttggggactaagat

SEQ ID NO: 416 - DNA, 32 bp, Artificial Sequence
  Synthetic polynucleotide
agacgacggatctcctgcatgccggtagcacc

SEQ ID NO: 417 - DNA, 32 bp, Artificial Sequence
  Synthetic polynucleotide
cagcttgacgcaagacgctaatcactgggcag

SEQ ID NO: 418 - DNA, 32 bp, Artificial Sequence
  Synthetic polynucleotide
gcgattcgcatgtagccgaacgagatcgtcct

SEQ ID NO: 419 - DNA, 32 bp, Artificial Sequence
  Synthetic polynucleotide
gtcaaatatgcgtgcttttaacgctttagacc

SEQ ID NO: 420 - DNA, 32 bp, Artificial Sequence
  Synthetic polynucleotide
agcgtagtaagggttacaagttcctgcggcgg

SEQ ID NO: 421 - DNA, 32 bp, Artificial Sequence
  Synthetic polynucleotide
caccagcaggatgtcgagcccacaacttgaca

SEQ ID NO: 422 - DNA, 32 bp, Artificial Sequence
  Synthetic polynucleotide
ggtcctaggttgcagaaacctaccccctaagc

SEQ ID NO: 423 - DNA, 48 bp, Artificial Sequence
  Synthetic polynucleotide
ctgtacgaatgagtccggccttgacatgacattctcccacccgtccaa

SEQ ID NO: 424 - DNA, 16 bp, Artificial Sequence
  Synthetic polynucleotide
gtagtacagtatcttt

SEQ ID NO: 425 - DNA, 48 bp, Artificial Sequence
  Synthetic polynucleotide
tttcatggcggcgatgtcgccgtttgctcgcgtgcgtacggcttttat

SEQ ID NO: 426 - DNA, 48 bp, Artificial Sequence
  Synthetic polynucleotide
agagtcgttatgccccccggttctgctagagtgggactggatcagatg

SEQ ID NO: 427 - DNA, 32 bp, Artificial Sequence
  Synthetic polynucleotide
atagcgtagaccggacaaccccgtaaatcgta

SEQ ID NO: 428 - DNA, 32 bp, Artificial Sequence
  Synthetic polynucleotide
ttcaagtattcggtgacctccccgcattacaa

SEQ ID NO: 429 - DNA, 32 bp, Artificial Sequence
  Synthetic polynucleotide
cgcgcttaccaagtaacgtatgtacgacgcga

SEQ ID NO: 430 - DNA, 32 bp, Artificial Sequence
  Synthetic polynucleotide
ggccaggcgatctaagtctggcgcgtgaggac

SEQ ID NO: 431 - DNA, 32 bp, Artificial Sequence
  Synthetic polynucleotide
tgcgagtgaacgggtggatgaatttcgttcgg

SEQ ID NO: 432 - DNA, 32 bp, Artificial Sequence
  Synthetic polynucleotide
acgtaagttgaagtaggaagctttttctagcc

SEQ ID NO: 433 - DNA, 48 bp, Artificial Sequence
  Synthetic polynucleotide
atagcatcgacactacgacctgcttttcgacacggactgcattctgga

SEQ ID NO: 434 - DNA, 48 bp, Artificial Sequence
  Synthetic polynucleotide
cagtaactgcattaactacgtgctcccaacataagtgacgtcctcagc

SEQ ID NO: 435 - DNA, 16 bp, Artificial Sequence
  Synthetic polynucleotide
gtattaatgccgcgcc

SEQ ID NO: 436 - DNA, 32 bp, Artificial Sequence
  Synthetic polynucleotide
agttgaaaattatctcgataagcagaaggacc

SEQ ID NO: 437 - DNA, 48 bp, Artificial Sequence
  Synthetic polynucleotide
tgtataactggcaagagacaaggccgcttcagaaaggatagccggacc

SEQ ID NO: 438 - DNA, 32 bp, Artificial Sequence
  Synthetic polynucleotide
tattctatgaaaccattctcgggtcgagcggg

SEQ ID NO: 439 - DNA, 32 bp, Artificial Sequence
  Synthetic polynucleotide
gttccgcgcgaatagctcacaggcgaactacg

SEQ ID NO: 440 - DNA, 32 bp, Artificial Sequence
  Synthetic polynucleotide
aacggtttcccggacctagtgtctatcaagtc

SEQ ID NO: 441 - DNA, 32 bp, Artificial Sequence
  Synthetic polynucleotide
tcactgttgtgacctacgagaagcgtatagat

SEQ ID NO: 442 - DNA, 32 bp, Artificial Sequence
  Synthetic polynucleotide
atacgacaggtggcaaaccacctccgatgtca

SEQ ID NO: 443 - DNA, 32 bp, Artificial Sequence
  Synthetic polynucleotide
tccatgggattcaccaagctcgtatacaccct

SEQ ID NO: 444 - DNA, 32 bp, Artificial Sequence
  Synthetic polynucleotide
tatgaattggtttaaacgctcctcgggaatta

SEQ ID NO: 445 - DNA, 48 bp, Artificial Sequence
  Synthetic polynucleotide
gcgccgcatacccattcactgtgaatttccacaccgaggattcgcagg

SEQ ID NO: 446 - DNA, 16 bp, Artificial Sequence
  Synthetic polynucleotide
gattctccatggcagc

SEQ ID NO: 447 - DNA, 16 bp, Artificial Sequence
  Synthetic polynucleotide
gtatgatttttttttt

SEQ ID NO: 448 - DNA, 16 bp, Artificial Sequence
  Synthetic polynucleotide
gatacttttttttttt

SEQ ID NO: 449 - DNA, 16 bp, Artificial Sequence
  Synthetic polynucleotide
caccgttctttttttt

SEQ ID NO: 450 - DNA, 16 bp, Artificial Sequence
  Synthetic polynucleotide
gggctgattttttttt

SEQ ID NO: 451 - DNA, 16 bp, Artificial Sequence
  Synthetic polynucleotide
tagcccggtttttttt

SEQ ID NO: 452 - DNA, 16 bp, Artificial Sequence
  Synthetic polynucleotide
ggggtcactttttttt

SEQ ID NO: 453 - DNA, 48 bp, Artificial Sequence
  Synthetic polynucleotide
ctatcttcataggacacaacagttaaccgtgaataatagtgcgcaggg

SEQ ID NO: 454 - DNA, 48 bp, Artificial Sequence
  Synthetic polynucleotide
tttttttttccggtttagcgaatttatgctctcgcacggcgaagcgta

SEQ ID NO: 455 - DNA, 48 bp, Artificial Sequence
  Synthetic polynucleotide
ttttttttgagccacttaacctggccatccctcatcttttgcttgaac

SEQ ID NO: 456 - DNA, 48 bp, Artificial Sequence
  Synthetic polynucleotide
aagtaaacttgagactacccgagcgagatgcgcgtttgtcggggtcgt

SEQ ID NO: 457 - DNA, 48 bp, Artificial Sequence
  Synthetic polynucleotide
acaggcgggtgcgttgagttcgtaaagtgtgttatgattgttatgcta

SEQ ID NO: 458 - DNA, 48 bp, Artificial Sequence
  Synthetic polynucleotide
tttttttttactcgatcactgagttaagcgttagatgttcttaatttg

SEQ ID NO: 459 - DNA, 48 bp, Artificial Sequence
  Synthetic polynucleotide
ttttttttgaaaaggcgacatgaatactctgaatccttccaggtcagg

SEQ ID NO: 460 - DNA, 48 bp, Artificial Sequence
  Synthetic polynucleotide
atgaacaccccgctgcgcaccgaaaaaagcccctttacgcaacatctc

SEQ ID NO: 461 - DNA, 48 bp, Artificial Sequence
  Synthetic polynucleotide
gtggctgggcggccatatttccgcggcttcatgagggaactgcgatca

SEQ ID NO: 462 - DNA, 48 bp, Artificial Sequence
  Synthetic polynucleotide
ttttttttcgctcagcgtattagcacagctaacagagccgagttttgg

SEQ ID NO: 463 - DNA, 48 bp, Artificial Sequence
  Synthetic polynucleotide
ttttttttgttccggttcagaaaccccgcaacggcatcactcgcgatc

SEQ ID NO: 464 - DNA, 48 bp, Artificial Sequence
  Synthetic polynucleotide
aacagcatctcccggtgcatcagacagtctctccaggtcattccagct

SEQ ID NO: 465 - DNA, 32 bp, Artificial Sequence
  Synthetic polynucleotide
attaccgtttttttttttttttttatagccag

SEQ ID NO: 466 - DNA, 32 bp, Artificial Sequence; identical to SEQ ID NO: 127
  Synthetic polynucleotide

SEQ ID NO: 467 - DNA, 32 bp, Artificial Sequence
  Synthetic polynucleotide
ttttttttaacctcgtatcgactatttttttt

SEQ ID NO: 468 - DNA, 32 bp, Artificial Sequence
  Synthetic polynucleotide
ttttttttggaaggacgagtcggctttttttt

SEQ ID NO: 469 - DNA, 32 bp, Artificial Sequence
  Synthetic polynucleotide
ctaatatatcgttcgaccagccgcctgacaga

SEQ ID NO: 470 - DNA, 32 bp, Artificial Sequence
  Synthetic polynucleotide
cccagtgattttttttttttttttaggatatg

SEQ ID NO: 471 - DNA, 32 bp, Artificial Sequence
  Synthetic polynucleotide
gtcgctggttttttttttttttttgtgggacg

SEQ ID NO: 472 - DNA, 32 bp, Artificial Sequence
  Synthetic polynucleotide
ttagtgagagacgtgcagcttgggcaaccaaa

SEQ ID NO: 473 - DNA, 32 bp, Artificial Sequence
  Synthetic polynucleotide
ttttttttgcccctcggcgggccgtttttttt

SEQ ID NO: 474 - DNA, 32 bp, Artificial Sequence
  Synthetic polynucleotide
ttttttttgctcgacatagctccgtttttttt

SEQ ID NO: 475 - DNA, 32 bp, Artificial Sequence
  Synthetic polynucleotide
tctttctcgtatatcaaaagactgggggatga

SEQ ID NO: 476 - DNA, 32 bp, Artificial Sequence
  Synthetic polynucleotide
tcacattatttttttttttttttttgcgagat

SEQ ID NO: 477 - DNA, 32 bp, Artificial Sequence; identical to SEQ ID NO: 143
  Synthetic polynucleotide

SEQ ID NO: 478 - DNA, 32 bp, Artificial Sequence
  Synthetic polynucleotide
aattctcactaatcacttcttaaactagaaat

SEQ ID NO: 479 - DNA, 32 bp, Artificial Sequence
  Synthetic polynucleotide
ttttttttgtttccttcaccagaatttttttt

SEQ ID NO: 480 - DNA, 32 bp, Artificial Sequence
  Synthetic polynucleotide
ttttttttgatgtccgacactgactttttttt

SEQ ID NO: 481 - DNA, 32 bp, Artificial Sequence
  Synthetic polynucleotide
gatagctgtgagctttccatatccaccctttt

SEQ ID NO: 482 - DNA, 32 bp, Artificial Sequence
  Synthetic polynucleotide
gtttgaacttttttttttttttttccattata

SEQ ID NO: 483 - DNA, 32 bp, Artificial Sequence
  Synthetic polynucleotide
gccggagtcacccccgcggaacagatattaag

SEQ ID NO: 484 - DNA, 32 bp, Artificial Sequence
  Synthetic polynucleotide
ccaagtcactatgtaggcggaacccccgagcc

SEQ ID NO: 485 - DNA, 32 bp, Artificial Sequence
  Synthetic polynucleotide
ctttaggctgggtaagctaccgcttcgagaaa

SEQ ID NO: 486 - DNA, 32 bp, Artificial Sequence
  Synthetic polynucleotide
cgagtcgtgtatagcgcgagggttaggagaaa

SEQ ID NO: 487 - DNA, 32 bp, Artificial Sequence
  Synthetic polynucleotide
cacgcgagcagaagtggctatgctccaaggca

SEQ ID NO: 488 - DNA, 32 bp, Artificial Sequence
  Synthetic polynucleotide
agtttcctgaaggagtgttatttctgtttcac

SEQ ID NO: 489 - DNA, 32 bp, Artificial Sequence
  Synthetic polynucleotide
gacagggaccaccgcacctatcttttacttcg

SEQ ID NO: 490 - DNA, 32 bp, Artificial Sequence
  Synthetic polynucleotide
cccccaagacgcttagctcgtgctacgcttac

SEQ ID NO: 491 - DNA, 32 bp, Artificial Sequence
  Synthetic polynucleotide
aactactgggatatcggaacttgaaggtagag

SEQ ID NO: 492 - DNA, 32 bp, Artificial Sequence
  Synthetic polynucleotide
tggagttactgtttactcatccggtatttcga

SEQ ID NO: 493 - DNA, 32 bp, Artificial Sequence
  Synthetic polynucleotide
cttacatcgaatatggcataggtactgctcta

SEQ ID NO: 494 - DNA, 32 bp, Artificial Sequence
  Synthetic polynucleotide
ggtcagaagccccctatgacgatcatcatggt

SEQ ID NO: 495 - DNA, 32 bp, Artificial Sequence
  Synthetic polynucleotide
gaggcggcttttttttttttttttgcctgttt

SEQ ID NO: 496 - DNA, 32 bp, Artificial Sequence; identical to SEQ ID NO: 248
  Synthetic polynucleotide

SEQ ID NO: 497 - DNA, 32 bp, Artificial Sequence
  Synthetic polynucleotide
ttttttttaccataccaggtggcctttttttt

SEQ ID NO: 498 - DNA, 32 bp, Artificial Sequence
  Synthetic polynucleotide
tttttttttgccgaggctaacgattttttttt

SEQ ID NO: 499 - DNA, 32 bp, Artificial Sequence
  Synthetic polynucleotide
agctatggttgctttaatcagttagtgggagg

SEQ ID NO: 500 - DNA, 32 bp, Artificial Sequence
  Synthetic polynucleotide
gtgggtaattttttttttttttttcttgcctc

SEQ ID NO: 501 - DNA, 32 bp, Artificial Sequence
  Synthetic polynucleotide
cgtgcacattttttttttttttttcgcagggt

SEQ ID NO: 502 - DNA, 32 bp, Artificial Sequence
  Synthetic polynucleotide
agtatagttcacgtggtaggttaattctggtc

SEQ ID NO: 503 - DNA, 32 bp, Artificial Sequence
  Synthetic polynucleotide
ttttttttactgttagcctctccctttttttt

SEQ ID NO: 504 - DNA, 32 bp, Artificial Sequence
  Synthetic polynucleotide
ttttttttgttatggaagattgtatttttttt

SEQ ID NO: 505 - DNA, 32 bp, Artificial Sequence
  Synthetic polynucleotide
cggtgagattccccaggtccaacagctgtgac

SEQ ID NO: 506 - DNA, 32 bp, Artificial Sequence
  Synthetic polynucleotide
tccaaacctttttttttttttttttgataatc

SEQ ID NO: 507 - DNA, 32 bp, Artificial Sequence; identical to SEQ ID NO: 264
  Synthetic polynucleotide

SEQ ID NO: 508 - DNA, 32 bp, Artificial Sequence
  Synthetic polynucleotide
atatcaagagaaactggtattactttcataac

SEQ ID NO: 509 - DNA, 32 bp, Artificial Sequence
  Synthetic polynucleotide
ttttttttgcaacctaggtacacgtttttttt

SEQ ID NO: 510 - DNA, 32 bp, Artificial Sequence
  Synthetic polynucleotide
tttttttttatgtgatagctgttctttttttt

SEQ ID NO: 511 - DNA, 32 bp, Artificial Sequence
  Synthetic polynucleotide
cctacaatgtgacacggtcgcatatccccgtc

SEQ ID NO: 512 - DNA, 32 bp, Artificial Sequence
  Synthetic polynucleotide
caggctactttttttttttttttttatcccaa

SEQ ID NO: 513 - DNA, 32 bp, Artificial Sequence
  Synthetic polynucleotide
cttgacgagtataacctactaaaacaagaact

SEQ ID NO: 514 - DNA, 32 bp, Artificial Sequence
  Synthetic polynucleotide
tcagacgctcgggcactagtttgataagccac

SEQ ID NO: 515 - DNA, 32 bp, Artificial Sequence
  Synthetic polynucleotide
gggcactcatcgggttagctctgtattgaaag

SEQ ID NO: 516 - DNA, 32 bp, Artificial Sequence
  Synthetic polynucleotide
agtacgacacaacataaataaggatcctatga

SEQ ID NO: 517 - DNA, 32 bp, Artificial Sequence
  Synthetic polynucleotide
aatgcacaatccctgaactgtacgcagtagaa

SEQ ID NO: 518 - DNA, 32 bp, Artificial Sequence
  Synthetic polynucleotide
cacttgagagtgcgtacatatattcaaacatt

SEQ ID NO: 519 - DNA, 32 bp, Artificial Sequence
  Synthetic polynucleotide
taattagtacggccacggtacacctggggcac

SEQ ID NO: 520 - DNA, 32 bp, Artificial Sequence
  Synthetic polynucleotide
gagtgcaactaatcccatctggtctcacttgc

SEQ ID NO: 521 - DNA, 32 bp, Artificial Sequence
  Synthetic polynucleotide
atgtagcaagctttattatggtttgcccagcg

SEQ ID NO: 522 - DNA, 32 bp, Artificial Sequence
  Synthetic polynucleotide
gcaattgcgtccctcataactaaggaggatgt

SEQ ID NO: 523 - DNA, 32 bp, Artificial Sequence
  Synthetic polynucleotide
cgaatcaaaaattgtgcgcccactatccgaat

SEQ ID NO: 524 - DNA, 32 bp, Artificial Sequence
  Synthetic polynucleotide
gtgcagctgcgcgcctctaatgaaggagcact

SEQ ID NO: 525 - DNA, 32 bp, Artificial Sequence
  Synthetic polynucleotide
atgtggtttttttttttttttttttgggtgtt

SEQ ID NO: 526 - DNA, 32 bp, Artificial Sequence
  Synthetic polynucleotide
ccccggtatgactaccggcggtacgctgtatt

SEQ ID NO: 527 - DNA, 32 bp, Artificial Sequence
  Synthetic polynucleotide
ttttttttaggagaaggcggccattttttttt

SEQ ID NO: 528 - DNA, 32 bp, Artificial Sequence
  Synthetic polynucleotide
ttttttttacaccggcgtgtcaagtttttttt

SEQ ID NO: 529 - DNA, 32 bp, Artificial Sequence
  Synthetic polynucleotide
ttccgcgtcaaatctgtcatacgaggaagttc

SEQ ID NO: 530 - DNA, 32 bp, Artificial Sequence
  Synthetic polynucleotide
ggcgatacttttttttttttttttcgatcgcc

SEQ ID NO: 531 - DNA, 32 bp, Artificial Sequence
  Synthetic polynucleotide
gccactacttttttttttttttttggttggtt

SEQ ID NO: 532 - DNA, 32 bp, Artificial Sequence
  Synthetic polynucleotide
tctggttcgggtatagcgaccatggaccaagt

SEQ ID NO: 533 - DNA, 32 bp, Artificial Sequence
  Synthetic polynucleotide
ttttttttcccccgcaggaatgcatttttttt

SEQ ID NO: 534 - DNA, 32 bp, Artificial Sequence
  Synthetic polynucleotide
ttttttttagtggagccagcccattttttttt

SEQ ID NO: 535 - DNA, 32 bp, Artificial Sequence
  Synthetic polynucleotide
tagtccacgcgtatcgacatgtaatacccaca

SEQ ID NO: 536 - DNA, 32 bp, Artificial Sequence
  Synthetic polynucleotide
cctactcttttttttttttttttttctagcag

SEQ ID NO: 537 - DNA, 32 bp, Artificial Sequence
  Synthetic polynucleotide
ttccttttttttttttttttttttgccctcag

SEQ ID NO: 538 - DNA, 32 bp, Artificial Sequence
  Synthetic polynucleotide
agcctacggatattcactcggcccctatgaac

SEQ ID NO: 539 - DNA, 32 bp, Artificial Sequence
  Synthetic polynucleotide
ttttttttcccactgttggtggtttttttttt

SEQ ID NO: 540 - DNA, 32 bp, Artificial Sequence
  Synthetic polynucleotide
ttttttttttacttgcgacgaggttttttttt

SEQ ID NO: 541 - DNA, 32 bp, Artificial Sequence
  Synthetic polynucleotide
cgagatgtaggtctacaatgattagccgatct

SEQ ID NO: 542 - DNA, 32 bp, Artificial Sequence
  Synthetic polynucleotide
ccacatgattttttttttttttttttccgccc

SEQ ID NO: 543 - DNA, 32 bp, Artificial Sequence
  Synthetic polynucleotide
ggaggcggacgactttggtaggttttggacgg

SEQ ID NO: 544 - DNA, 32 bp, Artificial Sequence
  Synthetic polynucleotide
ccgcacgtgctgttcatcaaggccaaagatac

SEQ ID NO: 545 - DNA, 32 bp, Artificial Sequence
  Synthetic polynucleotide
cgtcttaaccattacgactacgcttctgcaac

SEQ ID NO: 546 - DNA, 32 bp, Artificial Sequence
  Synthetic polynucleotide
tttttgtcatacacaatgctggtgggactcat

SEQ ID NO: 547 - DNA, 32 bp, Artificial Sequence
  Synthetic polynucleotide
actttctggatggccgctcgttcgccgccgca

SEQ ID NO: 548 - DNA, 32 bp, Artificial Sequence
  Synthetic polynucleotide
agagtatataaatggtgcgttaaatgtcaagt

SEQ ID NO: 549 - DNA, 32 bp, Artificial Sequence
  Synthetic polynucleotide
gctcgaccgcgctttccgtcgtctgctacatg

SEQ ID NO: 550 - DNA, 32 bp, Artificial Sequence
  Synthetic polynucleotide
gaggtagcgcactgcctcaagctgagcacgca

SEQ ID NO: 551 - DNA, 32 bp, Artificial Sequence
  Synthetic polynucleotide
gattgccgtctcataagtaaacgaggtgctac

SEQ ID NO: 552 - DNA, 32 bp, Artificial Sequence
  Synthetic polynucleotide
ttggctgaaccgctctccccaagtctgcccag

SEQ ID NO: 553 - DNA, 32 bp, Artificial Sequence
  Synthetic polynucleotide
acttgggacacctttcactctcgtatgtaccg

SEQ ID NO: 554 - DNA, 32 bp, Artificial Sequence
  Synthetic polynucleotide
cagaaactttaggatctcgcaacgtaggtttc

SEQ ID NO: 555 - DNA, 32 bp, Artificial Sequence
  Synthetic polynucleotide
aacggcgattttttttttttttttgcttaggg

SEQ ID NO: 556 - DNA, 32 bp, Artificial Sequence
  Synthetic polynucleotide
agaaccggataaaagcgtgggagaatgtcatg

SEQ ID NO: 557 - DNA, 32 bp, Artificial Sequence
  Synthetic polynucleotide
ttttttttcatctgattgtactactttttttt

SEQ ID NO: 558 - DNA, 32 bp, Artificial Sequence
  Synthetic polynucleotide
ttttttttcatcgccgctaggacctttttttt

SEQ ID NO: 559 - DNA, 32 bp, Artificial Sequence
  Synthetic polynucleotide
tacgctatggggcatatcgtacagtaaccctt

SEQ ID NO: 560 - DNA, 32 bp, Artificial Sequence
  Synthetic polynucleotide
tacttgaattttttttttttttttcgacatcc

SEQ ID NO: 561 - DNA, 32 bp, Artificial Sequence
  Synthetic polynucleotide
tacatacgttttttttttttttttaggacgat

SEQ ID NO: 562 - DNA, 32 bp, Artificial Sequence
  Synthetic polynucleotide
gcgccagatacgatttggaacttgggtctaaa

SEQ ID NO: 563 - DNA, 32 bp, Artificial Sequence
  Synthetic polynucleotide
ttttttttttgtaatgtgtgggcttttttttt

SEQ ID NO: 564 - DNA, 32 bp, Artificial Sequence
  Synthetic polynucleotide
ttttttttttacttggcgaatcgctttttttt

SEQ ID NO: 565 - DNA, 32 bp, Artificial Sequence
  Synthetic polynucleotide
cactcgcacttagatctatttgacaggagatc

SEQ ID NO: 566 - DNA, 32 bp, Artificial Sequence
  Synthetic polynucleotide
acttacgtttttttttttttttttgtcttgcg

SEQ ID NO: 567 - DNA, 32 bp, Artificial Sequence
  Synthetic polynucleotide
gcagtccgtttttttttttttttttccgtgca

SEQ ID NO: 568 - DNA, 32 bp, Artificial Sequence
  Synthetic polynucleotide
cgtcacttccgaacgacggcatgcatcttagt

SEQ ID NO: 569 - DNA, 32 bp, Artificial Sequence
  Synthetic polynucleotide
ttttttttggctagaatgattagctttttttt

SEQ ID NO: 570 - DNA, 32 bp, Artificial Sequence
  Synthetic polynucleotide
tttttttttgtcgaaatggatatctttttttt

SEQ ID NO: 571 - DNA, 32 bp, Artificial Sequence
  Synthetic polynucleotide
gatgctatatgttgggtcttgcttatgccagc

SEQ ID NO: 572 - DNA, 32 bp, Artificial Sequence
  Synthetic polynucleotide
agttactgttttttttttttttttgcgaaaat

SEQ ID NO: 573 - DNA, 48 bp, Artificial Sequence
  Synthetic polynucleotide
cgtacgcacgcgagcagaggagcgcctgcgaatcctcggtgtggaaat

SEQ ID NO: 574 - DNA, 48 bp, Artificial Sequence
  Synthetic polynucleotide
ccagtcccactctagctcacagtggctgccatggagaatctttttttt

SEQ ID NO: 575 - DNA, 48 bp, Artificial Sequence
  Synthetic polynucleotide
ccatgaaagtccggtctgtcgtattttaaaccaattcatatttttttt

SEQ ID NO: 576 - DNA, 48 bp, Artificial Sequence
  Synthetic polynucleotide
acgactcttcaccgaacccatggaaatgggtatgcggcgcttgccacc

SEQ ID NO: 577 - DNA, 48 bp, Artificial Sequence
  Synthetic polynucleotide
acggggtttcgcgtcgagacactatgacatcggaggtggtatctatac

SEQ ID NO: 578 - DNA, 48 bp, Artificial Sequence
  Synthetic polynucleotide
cggggagggtcctcacgcttctcgagggtgtatacgagcttttttttt

SEQ ID NO: 579 - DNA, 48 bp, Artificial Sequence
  Synthetic polynucleotide
taagcgcgcacccgttatagaataggtccgggaaaccgtttttttttt

SEQ ID NO: 580 - DNA, 48 bp, Artificial Sequence
  Synthetic polynucleotide
gcctggccctacttcacgcggaactaggtcacaacagtgaatggtttc

SEQ ID NO: 581 - DNA, 48 bp, Artificial Sequence
  Synthetic polynucleotide
aattcatctccagaattgcttatccccgctcgacccgagaggtccggc

SEQ ID NO: 582 - DNA, 48 bp, Artificial Sequence
  Synthetic polynucleotide
aaagcttcgctgaggatatcctttcgtagttcgcctgtgatttttttt

SEQ ID NO: 583 - DNA, 48 bp, Artificial Sequence
  Synthetic polynucleotide
agcaggtcgtagtgtcgttatacagagataattttcaacttttttttt

SEQ ID NO: 584 - DNA, 48 bp, Artificial Sequence
  Synthetic polynucleotide
agcacgtagttaatgcattaatacctgaagcggccttgtctcttgcca

SEQ ID NO: 585 - DNA, 16 bp, Artificial Sequence
  Synthetic polynucleotide
ttttttttggcgcggc

SEQ ID NO: 586 - DNA, 16 bp, Artificial Sequence
  Synthetic polynucleotide
ttttttttggtccttc

SEQ ID NO: 587 - DNA, 16 bp, Artificial Sequence
  Synthetic polynucleotide
ttttttttgctattcg

SEQ ID NO: 588 - DNA, 16 bp, Artificial Sequence
  Synthetic polynucleotide
ttttttttgacttgat

SEQ ID NO: 589 - DNA, 16 bp, Artificial Sequence
  Synthetic polynucleotide
tttttttttggtgaat

SEQ ID NO: 590 - DNA, 16 bp, Artificial Sequence
  Synthetic polynucleotide
tttttttttaattccc

SEQ ID NO: 591 - DNA, 48 bp, Artificial Sequence; identical to SEQ ID NO: 82
  Synthetic polynucleotide

SEQ ID NO: 592 - DNA, 32 bp, Artificial Sequence; identical to SEQ ID NO: 83
  Synthetic polynucleotide

SEQ ID NO: 593 - DNA, 48 bp, Artificial Sequence; identical to SEQ ID NO: 84
  Synthetic polynucleotide

SEQ ID NO: 594 - DNA, 32 bp, Artificial Sequence; identical to SEQ ID NO: 6
  Synthetic polynucleotide

SEQ ID NO: 595 - DNA, 32 bp, Artificial Sequence; identical to SEQ ID NO: 7
  Synthetic polynucleotide

SEQ ID NO: 596 - DNA, 32 bp, Artificial Sequence; identical to SEQ ID NO: 8
  Synthetic polynucleotide

SEQ ID NO: 597 - DNA, 32 bp, Artificial Sequence; identical to SEQ ID NO: 9
  Synthetic polynucleotide

SEQ ID NO: 598 - DNA, 32 bp, Artificial Sequence; identical to SEQ ID NO: 10
  Synthetic polynucleotide

SEQ ID NO: 599 - DNA, 48 bp, Artificial Sequence; identical to SEQ ID NO: 96
  Synthetic polynucleotide

SEQ ID NO: 600 - DNA, 48 bp, Artificial Sequence; identical to SEQ ID NO: 97
  Synthetic polynucleotide

SEQ ID NO: 601 - DNA, 16 bp, Artificial Sequence
  Synthetic polynucleotide
gtcagtgtgatcgcga

SEQ ID NO: 602 - DNA, 32 bp, Artificial Sequence; identical to SEQ ID NO: 104
  Synthetic polynucleotide

SEQ ID NO: 603 - DNA, 48 bp, Artificial Sequence; identical to SEQ ID NO: 105
  Synthetic polynucleotide

SEQ ID NO: 604 - DNA, 32 bp, Artificial Sequence; identical to SEQ ID NO: 19
  Synthetic polynucleotide

SEQ ID NO: 605 - DNA, 32 bp, Artificial Sequence; identical to SEQ ID NO: 20
  Synthetic polynucleotide

SEQ ID NO: 606 - DNA, 32 bp, Artificial Sequence; identical to SEQ ID NO: 21
  Synthetic polynucleotide

SEQ ID NO: 607 - DNA, 32 bp, Artificial Sequence; identical to SEQ ID NO: 22
  Synthetic polynucleotide

SEQ ID NO: 608 - DNA, 32 bp, Artificial Sequence; identical to SEQ ID NO: 23
  Synthetic polynucleotide

SEQ ID NO: 609 - DNA, 32 bp, Artificial Sequence; identical to SEQ ID NO: 24
  Synthetic polynucleotide

SEQ ID NO: 610 - DNA, 16 bp, Artificial Sequence
  Synthetic polynucleotide
gcggctggacgacccc

SEQ ID NO: 611 - DNA, 48 bp, Artificial Sequence; identical to SEQ ID NO: 123
  Synthetic polynucleotide

SEQ ID NO: 612 - DNA, 32 bp, Artificial Sequence; identical to SEQ ID NO: 28
  Synthetic polynucleotide

SEQ ID NO: 613 - DNA, 48 bp, Artificial Sequence; identical to SEQ ID NO: 130
  Synthetic polynucleotide

SEQ ID NO: 614 - DNA, 32 bp, Artificial Sequence; identical to SEQ ID NO: 131
  Synthetic polynucleotide

SEQ ID NO: 615 - DNA, 48 bp, Artificial Sequence; identical to SEQ ID NO: 132
  Synthetic polynucleotide

SEQ ID NO: 616 - DNA, 32 bp, Artificial Sequence; identical to SEQ ID NO: 34
  Synthetic polynucleotide

SEQ ID NO: 617 - DNA, 32 bp, Artificial Sequence; identical to SEQ ID NO: 35
  Synthetic polynucleotide

SEQ ID NO: 618 - DNA, 32 bp, Artificial Sequence; identical to SEQ ID NO: 36
  Synthetic polynucleotide

SEQ ID NO: 619 - DNA, 32 bp, Artificial Sequence; identical to SEQ ID NO: 37
  Synthetic polynucleotide

SEQ ID NO: 620 - DNA, 32 bp, Artificial Sequence; identical to SEQ ID NO: 38
  Synthetic polynucleotide

SEQ ID NO: 621 - DNA, 48 bp, Artificial Sequence; identical to SEQ ID NO: 148
  Synthetic polynucleotide

SEQ ID NO: 622 - DNA, 48 bp, Artificial Sequence; identical to SEQ ID NO: 149
  Synthetic polynucleotide

SEQ ID NO: 623 - DNA, 16 bp, Artificial Sequence
  Synthetic polynucleotide
gaacagcttagagcag

SEQ ID NO: 624 - DNA, 32 bp, Artificial Sequence; identical to SEQ ID NO: 156
  Synthetic polynucleotide

SEQ ID NO: 625 - DNA, 48 bp, Artificial Sequence; identical to SEQ ID NO: 226
  Synthetic polynucleotide

SEQ ID NO: 626 - DNA, 32 bp, Artificial Sequence; identical to SEQ ID NO: 47
  Synthetic polynucleotide

SEQ ID NO: 627 - DNA, 32 bp, Artificial Sequence; identical to SEQ ID NO: 48
  Synthetic polynucleotide

SEQ ID NO: 628 - DNA, 32 bp, Artificial Sequence; identical to SEQ ID NO: 49
  Synthetic polynucleotide

SEQ ID NO: 629 - DNA, 32 bp, Artificial Sequence; identical to SEQ ID NO: 50
  Synthetic polynucleotide

SEQ ID NO: 630 - DNA, 32 bp, Artificial Sequence; identical to SEQ ID NO: 51
  Synthetic polynucleotide

SEQ ID NO: 631 - DNA, 32 bp, Artificial Sequence; identical to SEQ ID NO: 52
  Synthetic polynucleotide

SEQ ID NO: 632 - DNA, 16 bp, Artificial Sequence
  Synthetic polynucleotide
taactgattttctcct

SEQ ID NO: 633 - DNA, 48 bp, Artificial Sequence; identical to SEQ ID NO: 244
  Synthetic polynucleotide

SEQ ID NO: 634 - DNA, 32 bp, Artificial Sequence; identical to SEQ ID NO: 56
  Synthetic polynucleotide

SEQ ID NO: 635 - DNA, 48 bp, Artificial Sequence; identical to SEQ ID NO: 251
  Synthetic polynucleotide

SEQ ID NO: 636 - DNA, 32 bp, Artificial Sequence; identical to SEQ ID NO: 252
  Synthetic polynucleotide

SEQ ID NO: 637 - DNA, 48 bp, Artificial Sequence; identical to SEQ ID NO: 253
  Synthetic polynucleotide

SEQ ID NO: 638 - DNA, 32 bp, Artificial Sequence; identical to SEQ ID NO: 62
  Synthetic polynucleotide

SEQ ID NO: 639 - DNA, 32 bp, Artificial Sequence; identical to SEQ ID NO: 63
  Synthetic polynucleotide

SEQ ID NO: 640 - DNA, 32 bp, Artificial Sequence; identical to SEQ ID NO: 64
  Synthetic polynucleotide

SEQ ID NO: 641 - DNA, 32 bp, Artificial Sequence; identical to SEQ ID NO: 65
  Synthetic polynucleotide

SEQ ID NO: 642 - DNA, 32 bp, Artificial Sequence; identical to SEQ ID NO: 66
  Synthetic polynucleotide

SEQ ID NO: 643 - DNA, 48 bp, Artificial Sequence; identical to SEQ ID NO: 269
  Synthetic polynucleotide

SEQ ID NO: 644 - DNA, 48 bp, Artificial Sequence; identical to SEQ ID NO: 270
  Synthetic polynucleotide

SEQ ID NO: 645 - DNA, 16 bp, Artificial Sequence
  Synthetic polynucleotide
acctcgtcattcggat

SEQ ID NO: 646 - DNA, 32 bp, Artificial Sequence; identical to SEQ ID NO: 276
  Synthetic polynucleotide

SEQ ID NO: 647 - DNA, 48 bp, Artificial Sequence; identical to SEQ ID NO: 277
  Synthetic polynucleotide

SEQ ID NO: 648 - DNA, 32 bp, Artificial Sequence; identical to SEQ ID NO: 75
  Synthetic polynucleotide

SEQ ID NO: 649 - DNA, 32 bp, Artificial Sequence; identical to SEQ ID NO: 76
  Synthetic polynucleotide

SEQ ID NO: 650 - DNA, 32 bp, Artificial Sequence; identical to SEQ ID NO: 77
  Synthetic polynucleotide

SEQ ID NO: 651 - DNA, 32 bp, Artificial Sequence; identical to SEQ ID NO: 78
  Synthetic polynucleotide

SEQ ID NO: 652 - DNA, 32 bp, Artificial Sequence; identical to SEQ ID NO: 157
  Synthetic polynucleotide

SEQ ID NO: 653 - DNA, 32 bp, Artificial Sequence; identical to SEQ ID NO: 158
  Synthetic polynucleotide

SEQ ID NO: 654 - DNA, 16 bp, Artificial Sequence
  Synthetic polynucleotide
tcgtatgatcatagga

SEQ ID NO: 655 - DNA, 48 bp, Artificial Sequence; identical to SEQ ID NO: 293
  Synthetic polynucleotide

SEQ ID NO: 656 - DNA, 32 bp, Artificial Sequence; identical to SEQ ID NO: 162
  Synthetic polynucleotide

SEQ ID NO: 657 - DNA, 16 bp, Artificial Sequence
  Synthetic polynucleotide
gtatgatttttttttt

SEQ ID NO: 658 - DNA, 48 bp, Artificial Sequence; identical to SEQ ID NO: 80
  Synthetic polynucleotide

SEQ ID NO: 659 - DNA, 48 bp, Artificial Sequence; identical to SEQ ID NO: 81
  Synthetic polynucleotide

SEQ ID NO: 660 - DNA, 16 bp, Artificial Sequence
  Synthetic polynucleotide
caccgttctttttttt

SEQ ID NO: 661 - DNA, 48 bp, Artificial Sequence; identical to SEQ ID NO: 87
  Synthetic polynucleotide

SEQ ID NO: 662 - DNA, 48 bp, Artificial Sequence; identical to SEQ ID NO: 88
  Synthetic polynucleotide

SEQ ID NO: 663 - DNA, 16 bp, Artificial Sequence
  Synthetic polynucleotide
tagcccggtttttttt

SEQ ID NO: 664 - DNA, 48 bp, Artificial Sequence; identical to SEQ ID NO: 94
  Synthetic polynucleotide

SEQ ID NO: 665 - DNA, 48 bp, Artificial Sequence; identical to SEQ ID NO: 95
  Synthetic polynucleotide

SEQ ID NO: 666 - DNA, 48 bp, Artificial Sequence; identical to SEQ ID NO: 99
  Synthetic polynucleotide

SEQ ID NO: 667 - DNA, 32 bp, Artificial Sequence; identical to SEQ ID NO: 100
  Synthetic polynucleotide

SEQ ID NO: 668 - DNA, 48 bp, Artificial Sequence; identical to SEQ ID NO: 101
  Synthetic polynucleotide

SEQ ID NO: 669 - DNA, 32 bp, Artificial Sequence; identical to SEQ ID NO: 102
  Synthetic polynucleotide

SEQ ID NO: 670 - DNA, 32 bp, Artificial Sequence; identical to SEQ ID NO: 103
  Synthetic polynucleotide

SEQ ID NO: 671 - DNA, 48 bp, Artificial Sequence; identical to SEQ ID NO: 108
  Synthetic polynucleotide

SEQ ID NO: 672 - DNA, 32 bp, Artificial Sequence; identical to SEQ ID NO: 109
  Synthetic polynucleotide

SEQ ID NO: 673 - DNA, 48 bp, Artificial Sequence; identical to SEQ ID NO: 110
  Synthetic polynucleotide

SEQ ID NO: 674 - DNA, 32 bp, Artificial Sequence; identical to SEQ ID NO: 111
  Synthetic polynucleotide

SEQ ID NO: 675 - DNA, 32 bp, Artificial Sequence; identical to SEQ ID NO: 112
  Synthetic polynucleotide

SEQ ID NO: 676 - DNA, 48 bp, Artificial Sequence; identical to SEQ ID NO: 117
  Synthetic polynucleotide

SEQ ID NO: 677 - DNA, 32 bp, Artificial Sequence; identical to SEQ ID NO: 118
  Synthetic polynucleotide

SEQ ID NO: 678 - DNA, 48 bp, Artificial Sequence; identical to SEQ ID NO: 119
  Synthetic polynucleotide

SEQ ID NO: 679 - DNA, 32 bp, Artificial Sequence; identical to SEQ ID NO: 120
  Synthetic polynucleotide

SEQ ID NO: 680 - DNA, 32 bp, Artificial Sequence; identical to SEQ ID NO: 121
  Synthetic polynucleotide

SEQ ID NO: 681 - DNA, 32 bp, Artificial Sequence; identical to SEQ ID NO: 125
  Synthetic polynucleotide

SEQ ID NO: 682 - DNA, 32 bp, Artificial Sequence; identical to SEQ ID NO: 126
  Synthetic polynucleotide

SEQ ID NO: 683 - DNA, 32 bp, Artificial Sequence; identical to SEQ ID NO: 127
  Synthetic polynucleotide

SEQ ID NO: 684 - DNA, 32 bp, Artificial Sequence; identical to SEQ ID NO: 128
  Synthetic polynucleotide

SEQ ID NO: 685 - DNA, 32 bp, Artificial Sequence; identical to SEQ ID NO: 129
  Synthetic polynucleotide

SEQ ID NO: 686 - DNA, 32 bp, Artificial Sequence; identical to SEQ ID NO: 134
  Synthetic polynucleotide

SEQ ID NO: 687 - DNA, 32 bp, Artificial Sequence; identical to SEQ ID NO: 135
  Synthetic polynucleotide

SEQ ID NO: 688 - DNA, 32 bp, Artificial Sequence; identical to SEQ ID NO: 136
  Synthetic polynucleotide

SEQ ID NO: 689 - DNA, 32 bp, Artificial Sequence; identical to SEQ ID NO: 137
  Synthetic polynucleotide

SEQ ID NO: 690 - DNA, 32 bp, Artificial Sequence; identical to SEQ ID NO: 138
  Synthetic polynucleotide

SEQ ID NO: 691 - DNA, 32 bp, Artificial Sequence; identical to SEQ ID NO: 143
  Synthetic polynucleotide

SEQ ID NO: 692 - DNA, 32 bp, Artificial Sequence; identical to SEQ ID NO: 144
  Synthetic polynucleotide

SEQ ID NO: 693 - DNA, 32 bp, Artificial Sequence; identical to SEQ ID NO: 145
  Synthetic polynucleotide

SEQ ID NO: 694 - DNA, 32 bp, Artificial Sequence; identical to SEQ ID NO: 146
  Synthetic polynucleotide

SEQ ID NO: 695 - DNA, 32 bp, Artificial Sequence; identical to SEQ ID NO: 147
  Synthetic polynucleotide

SEQ ID NO: 696 - DNA, 32 bp, Artificial Sequence; identical to SEQ ID NO: 151
  Synthetic polynucleotide

SEQ ID NO: 697 - DNA, 32 bp, Artificial Sequence; identical to SEQ ID NO: 152
  Synthetic polynucleotide

SEQ ID NO: 698 - DNA, 32 bp, Artificial Sequence; identical to SEQ ID NO: 153
  Synthetic polynucleotide

SEQ ID NO: 699 - DNA, 32 bp, Artificial Sequence; identical to SEQ ID NO: 154
  Synthetic polynucleotide

SEQ ID NO: 700 - DNA, 32 bp, Artificial Sequence; identical to SEQ ID NO: 155
  Synthetic polynucleotide

SEQ ID NO: 701 - DNA, 32 bp, Artificial Sequence; identical to SEQ ID NO: 229
  Synthetic polynucleotide

SEQ ID NO: 702 - DNA, 32 bp, Artificial Sequence; identical to SEQ ID NO: 230
  Synthetic polynucleotide

SEQ ID NO: 703 - DNA, 32 bp, Artificial Sequence; identical to SEQ ID NO: 221
  Synthetic polynucleotide

SEQ ID NO: 704 - DNA, 32 bp, Artificial Sequence; identical to SEQ ID NO: 222
  Synthetic polynucleotide

SEQ ID NO: 705 - DNA, 32 bp, Artificial Sequence; identical to SEQ ID NO: 223
  Synthetic polynucleotide

SEQ ID NO: 706 - DNA, 32 bp, Artificial Sequence; identical to SEQ ID NO: 238
  Synthetic polynucleotide

SEQ ID NO: 707 - DNA, 32 bp, Artificial Sequence; identical to SEQ ID NO: 239
  Synthetic polynucleotide

SEQ ID NO: 708 - DNA, 32 bp, Artificial Sequence; identical to SEQ ID NO: 240
  Synthetic polynucleotide

SEQ ID NO: 709 - DNA, 32 bp, Artificial Sequence; identical to SEQ ID NO: 241
  Synthetic polynucleotide

SEQ ID NO: 710 - DNA, 32 bp, Artificial Sequence; identical to SEQ ID NO: 242
  Synthetic polynucleotide

SEQ ID NO: 711 - DNA, 32 bp, Artificial Sequence; identical to SEQ ID NO: 246
  Synthetic polynucleotide

SEQ ID NO: 712 - DNA, 48 bp, Artificial Sequence; identical to SEQ ID NO: 247
  Synthetic polynucleotide

SEQ ID NO: 713 - DNA, 32 bp, Artificial Sequence; identical to SEQ ID NO: 248
  Synthetic polynucleotide

SEQ ID NO: 714 - DNA, 48 bp, Artificial Sequence; identical to SEQ ID NO: 249
  Synthetic polynucleotide

SEQ ID NO: 715 - DNA, 32 bp, Artificial Sequence; identical to SEQ ID NO: 250
  Synthetic polynucleotide

SEQ ID NO: 716 - DNA, 32 bp, Artificial Sequence; identical to SEQ ID NO: 255
  Synthetic polynucleotide

SEQ ID NO: 717 - DNA, 48 bp, Artificial Sequence; identical to SEQ ID NO: 256
  Synthetic polynucleotide

SEQ ID NO: 718 - DNA, 32 bp, Artificial Sequence; identical to SEQ ID NO: 257
  Synthetic polynucleotide

SEQ ID NO: 719 - DNA, 48 bp, Artificial Sequence; identical to SEQ ID NO: 258
  Synthetic polynucleotide

SEQ ID NO: 720 - DNA, 32 bp, Artificial Sequence; identical to SEQ ID NO: 259
  Synthetic polynucleotide

SEQ ID NO: 721 - DNA, 32 bp, Artificial Sequence; identical to SEQ ID NO: 264
  Synthetic polynucleotide

SEQ ID NO: 722 - DNA, 48 bp, Artificial Sequence; identical to SEQ ID NO: 265
  Synthetic polynucleotide

SEQ ID NO: 723 - DNA, 32 bp, Artificial Sequence; identical to SEQ ID NO: 266
  Synthetic polynucleotide

SEQ ID NO: 724 - DNA, 48 bp, Artificial Sequence; identical to SEQ ID NO: 267
  Synthetic polynucleotide

SEQ ID NO: 725 - DNA, 32 bp, Artificial Sequence; identical to SEQ ID NO: 268
  Synthetic polynucleotide

SEQ ID NO: 726 - DNA, 48 bp, Artificial Sequence; identical to SEQ ID NO: 272
  Synthetic polynucleotide

SEQ ID NO: 727 - DNA, 48 bp, Artificial Sequence; identical to SEQ ID NO: 273
  Synthetic polynucleotide

SEQ ID NO: 728 - DNA, 32 bp, Artificial Sequence; identical to SEQ ID NO: 274
  Synthetic polynucleotide

SEQ ID NO: 729 - DNA, 16 bp, Artificial Sequence
  Synthetic polynucleotide
ttttttttgccctcag

SEQ ID NO: 730 - DNA, 48 bp, Artificial Sequence; identical to SEQ ID NO: 280
  Synthetic polynucleotide

SEQ ID NO: 731 - DNA, 48 bp, Artificial Sequence; identical to SEQ ID NO: 281
  Synthetic polynucleotide

SEQ ID NO: 732 - DNA, 32 bp, Artificial Sequence; identical to SEQ ID NO: 282
  Synthetic polynucleotide

SEQ ID NO: 733 - DNA, 16 bp, Artificial Sequence
  Synthetic polynucleotide
tttttttttcacttgc

SEQ ID NO: 734 - DNA, 48 bp, Artificial Sequence; identical to SEQ ID NO: 288
  Synthetic polynucleotide

SEQ ID NO: 735 - DNA, 48 bp, Artificial Sequence; identical to SEQ ID NO: 289
  Synthetic polynucleotide

SEQ ID NO: 736 - DNA, 32 bp, Artificial Sequence; identical to SEQ ID NO: 290
  Synthetic polynucleotide

SEQ ID NO: 737 - DNA, 16 bp, Artificial Sequence
  Synthetic polynucleotide
tttttttttcctatga

SEQ ID NO: 738 - DNA, 48 bp, Artificial Sequence
  Synthetic polynucleotide
taacgtcaagtgcatcttcgaacaagcgtaaactcgtcagtcaagcga

SEQ ID NO: 739 - DNA, 32 bp, Artificial Sequence
  Synthetic polynucleotide
atcaggggtcaaaccacaaactcctcgatgaa

SEQ ID NO: 740 - DNA, 48 bp, Artificial Sequence
  Synthetic polynucleotide
ctggaacacgttgtaccgtaccatggcagttgcttgaccccttggctc

SEQ ID NO: 741 - DNA, 32 bp, Artificial Sequence
  Synthetic polynucleotide
cagctttgtgacgttgatgttggagaggaggt

SEQ ID NO: 742 - DNA, 32 bp, Artificial Sequence
  Synthetic polynucleotide
cgaaaggcttctacccatcacagtgagtggtt

SEQ ID NO: 743 - DNA, 32 bp, Artificial Sequence
  Synthetic polynucleotide
gagtggcaaaaggtgaaggtccaagggaaagt

SEQ ID NO: 744 - DNA, 32 bp, Artificial Sequence
  Synthetic polynucleotide
caggtcagatcacgtttgctctcctcatcccc

SEQ ID NO: 745 - DNA, 32 bp, Artificial Sequence
  Synthetic polynucleotide
tagaccctgacactcttgctctcatcgatgcg

SEQ ID NO: 746 - DNA, 48 bp, Artificial Sequence
  Synthetic polynucleotide
tttttcgggtgataggctaagcgtacaaggtggattggctgagggagt

SEQ ID NO: 747 - DNA, 48 bp, Artificial Sequence
  Synthetic polynucleotide
agtccgatacgctttgagctctttggggtaactggcatttctggggta

SEQ ID NO: 748 - DNA, 16 bp, Artificial Sequence
  Synthetic polynucleotide
gtccctctagcctgta

SEQ ID NO: 749 - DNA, 32 bp, Artificial Sequence
  Synthetic polynucleotide
caccactccctgatgacgtagactctgccaaa

SEQ ID NO: 750 - DNA, 48 bp, Artificial Sequence
  Synthetic polynucleotide
tcgaccatcctccaagcatccaagcaagctagtaggcagagtttcggt

SEQ ID NO: 751 - DNA, 32 bp, Artificial Sequence
  Synthetic polynucleotide
aggggaaccaaaggatcgatggagaaacggat

SEQ ID NO: 752 - DNA, 32 bp, Artificial Sequence
  Synthetic polynucleotide
acctgacaagtgcgatgcatccatgaccacag

SEQ ID NO: 753 - DNA, 32 bp, Artificial Sequence
  Synthetic polynucleotide
tttcgagaagctgaagactaggtgtgttgtta

SEQ ID NO: 754 - DNA, 32 bp, Artificial Sequence
  Synthetic polynucleotide
cggtttgcatcgatcggctaatccctgacagg

SEQ ID NO: 755 - DNA, 32 bp, Artificial Sequence
  Synthetic polynucleotide
aatcccaacaaacaacccagacacaacacaga

SEQ ID NO: 756 - DNA, 32 bp, Artificial Sequence
  Synthetic polynucleotide
ctgaccgattctagcccctggtatggccttga

SEQ ID NO: 757 - DNA, 16 bp, Artificial Sequence
  Synthetic polynucleotide
cctcacagctgatccc

SEQ ID NO: 758 - DNA, 48 bp, Artificial Sequence
  Synthetic polynucleotide
tctggttggactgggtcttctggtggaaaggtgtggtcgagatgctgt

SEQ ID NO: 759 - DNA, 32 bp, Artificial Sequence
  Synthetic polynucleotide
aggagagggaccacttaggcaaccatccaacc

SEQ ID NO: 760 - DNA, 48 bp, Artificial Sequence
  Synthetic polynucleotide
tccacaacagcagtacagcaagcatacgtttggagagcaagtggtcac

SEQ ID NO: 761 - DNA, 32 bp, Artificial Sequence
  Synthetic polynucleotide
atgtcgaactcgttacaccttgaccgttttcg

SEQ ID NO: 762 - DNA, 48 bp, Artificial Sequence
  Synthetic polynucleotide
atggggaagttccgtgatgagctgaaagtggtcctagcctgagtgctt

SEQ ID NO: 763 - DNA, 32 bp, Artificial Sequence
  Synthetic polynucleotide
cgtacccagtctccacgctagaaccactccat

SEQ ID NO: 764 - DNA, 32 bp, Artificial Sequence
  Synthetic polynucleotide
ggcataccagcaaagctaagcgttcaatcgtc

SEQ ID NO: 765 - DNA, 32 bp, Artificial Sequence
  Synthetic polynucleotide
agtttgggttgtgtgtctgtgtgaaagtcccc

SEQ ID NO: 766 - DNA, 32 bp, Artificial Sequence
  Synthetic polynucleotide
atgagtgcaaggcaaccatgaatcccgtagtc

SEQ ID NO: 767 - DNA, 32 bp, Artificial Sequence
  Synthetic polynucleotide
tggctaagctcctccatcacattcgtgcatag

SEQ ID NO: 768 - DNA, 48 bp, Artificial Sequence
  Synthetic polynucleotide
accgagttcgttggttacggaaagtggcattagcttcgaagagcagag

SEQ ID NO: 769 - DNA, 48 bp, Artificial Sequence
  Synthetic polynucleotide
catggtgaaagcttggttgtgttgcatctggaggacaggcattgatac

SEQ ID NO: 770 - DNA, 16 bp, Artificial Sequence
  Synthetic polynucleotide
ccttgactggtaccac

SEQ ID NO: 771 - DNA, 32 bp, Artificial Sequence
  Synthetic polynucleotide
tcctgatacgacactgacctctggaacgagtt

SEQ ID NO: 772 - DNA, 48 bp, Artificial Sequence
  Synthetic polynucleotide
ggggatttgcatgtctggctcatatgggggtatcgacattcacctcct

SEQ ID NO: 773 - DNA, 32 bp, Artificial Sequence
  Synthetic polynucleotide
cagactccagggtttctccgaagatcgtgtgt

SEQ ID NO: 774 - DNA, 32 bp, Artificial Sequence
  Synthetic polynucleotide
tccataccctgtgaaagctcgactaacggtga

SEQ ID NO: 775 - DNA, 32 bp, Artificial Sequence
  Synthetic polynucleotide
tgtctgctgactacgctgttttcgacctcagt

SEQ ID NO: 776 - DNA, 32 bp, Artificial Sequence
  Synthetic polynucleotide
gtgtgtgcattcggtagcctcatgagcgtaaa

SEQ ID NO: 777 - DNA, 32 bp, Artificial Sequence
  Synthetic polynucleotide
ccaggtcctgaagggagactgtaccggaaaac

SEQ ID NO: 778 - DNA, 32 bp, Artificial Sequence
  Synthetic polynucleotide
ccaaggagcaaacttctgtggactgatgtgca

SEQ ID NO: 779 - DNA, 16 bp, Artificial Sequence
  Synthetic polynucleotide
taccggaagagcaaca

SEQ ID NO: 780 - DNA, 48 bp, Artificial Sequence
  Synthetic polynucleotide
ctccctcgtacctcgaaaaggccttctcacctctcctcccatcccaat

SEQ ID NO: 781 - DNA, 32 bp, Artificial Sequence
  Synthetic polynucleotide
ctggttccttcagcattctcgagtgacagtag

SEQ ID NO: 782 - DNA, 48 bp, Artificial Sequence
  Synthetic polynucleotide
ccagtagtcccaacatcgaacctgaacagcattccacacttgacctcc

SEQ ID NO: 783 - DNA, 32 bp, Artificial Sequence
  Synthetic polynucleotide
atctgggaccactagcgatttcgggtacatgg

SEQ ID NO: 784 - DNA, 48 bp, Artificial Sequence
  Synthetic polynucleotide
tagccttgtctgtcagtgttccctgttcagcttggaggagtcaaccgg

SEQ ID NO: 785 - DNA, 32 bp, Artificial Sequence
  Synthetic polynucleotide
aagagacacacctaggctccatatcgggacag

SEQ ID NO: 786 - DNA, 32 bp, Artificial Sequence
  Synthetic polynucleotide
tgctcgtaggggtgttagccaagttgcattga

SEQ ID NO: 787 - DNA, 32 bp, Artificial Sequence
  Synthetic polynucleotide
ctcacctccttcactccattgaccccaaagac

SEQ ID NO: 788 - DNA, 32 bp, Artificial Sequence
  Synthetic polynucleotide
gttcatgaccgattcaacctcctcagttcgac

SEQ ID NO: 789 - DNA, 32 bp, Artificial Sequence
  Synthetic polynucleotide
caaaaccgtaaggcgatgaggggattagccga

SEQ ID NO: 790 - DNA, 48 bp, Artificial Sequence
  Synthetic polynucleotide
tggaacatggagacagcgaaaagggcttgacttggcgatgttggggta

SEQ ID NO: 791 - DNA, 48 bp, Artificial Sequence
  Synthetic polynucleotide
ctccagtgtgtggtagacagccttcgaacctagtgggaaacctgacaa

SEQ ID NO: 792 - DNA, 16 bp, Artificial Sequence
  Synthetic polynucleotide
gtggtccatccttcga

SEQ ID NO: 793 - DNA, 32 bp, Artificial Sequence
  Synthetic polynucleotide
gttgaacgttggtttgcttttcgtcctcagtg

SEQ ID NO: 794 - DNA, 48 bp, Artificial Sequence
  Synthetic polynucleotide
cctctaggggtactctgggtcttggagctttgaggtacggactcaacg

SEQ ID NO: 795 - DNA, 32 bp, Artificial Sequence
  Synthetic polynucleotide
tcatcctgttccaagctcctctacgagtcctg

SEQ ID NO: 796 - DNA, 32 bp, Artificial Sequence
  Synthetic polynucleotide
aatcctgcaacttgtgggtacctggaactgtg

SEQ ID NO: 797 - DNA, 32 bp, Artificial Sequence
  Synthetic polynucleotide
tagtccccttgaactggagtcctagtgtgtac

SEQ ID NO: 798 - DNA, 32 bp, Artificial Sequence
  Synthetic polynucleotide
gtctggaacgaagagaagcagtacaaccgtag

SEQ ID NO: 799 - DNA, 32 bp, Artificial Sequence
  Synthetic polynucleotide
tccatgggatctcgtgtttgcatacccctacc

SEQ ID NO: 800 - DNA, 32 bp, Artificial Sequence
  Synthetic polynucleotide
tgattggtgtgagcattcccgtaaaagcgtag

SEQ ID NO: 801 - DNA, 16 bp, Artificial Sequence
  Synthetic polynucleotide
acttgcctagacacgt

SEQ ID NO: 802 - DNA, 48 bp, Artificial Sequence
  Synthetic polynucleotide
ttggaaggaggtgattgggtgatcgacatggttgttcctgcttaacgg

SEQ ID NO: 803 - DNA, 32 bp, Artificial Sequence
  Synthetic polynucleotide
acttctgagcttttcgggatacgttggaacac

SEQ ID NO: 804 - DNA, 16 bp, Artificial Sequence
  Synthetic polynucleotide
tgttcgaatttttttt

SEQ ID NO: 805 - DNA, 48 bp, Artificial Sequence
  Synthetic polynucleotide
atggtacgtcgcttgactgacgagtttacgctctgtgaggacctttcc

SEQ ID NO: 806 - DNA, 48 bp, Artificial Sequence
  Synthetic polynucleotide
ttttttttgagccaaggggtcaagcaactgcccaaccagaaagtggtc

SEQ ID NO: 807 - DNA, 16 bp, Artificial Sequence
  Synthetic polynucleotide
actgtgattttttttt

SEQ ID NO: 808 - DNA, 48 bp, Artificial Sequence
  Synthetic polynucleotide
ggagagcattcatcgaggagtttgaaccactctctcgaaacgatcgat

SEQ ID NO: 809 - DNA, 48 bp, Artificial Sequence
  Synthetic polynucleotide
ttttttttacctcctctccaacatggggatgattgggattggctagaa

SEQ ID NO: 810 - DNA, 16 bp, Artificial Sequence
  Synthetic polynucleotide
agccaatctttttttt

SEQ ID NO: 811 - DNA, 48 bp, Artificial Sequence
  Synthetic polynucleotide
aaatgccaactttcccttggacctactccctcgagtggtgcttggagg

SEQ ID NO: 812 - DNA, 48 bp, Artificial Sequence
  Synthetic polynucleotide
ttttttttcgcatcgatgagagcataccccaggttcccctatcgcact

SEQ ID NO: 813 - DNA, 48 bp, Artificial Sequence
  Synthetic polynucleotide
agagggacttttttttttttttttcaccttgtacgcttagcctatcac

SEQ ID NO: 814 - DNA, 32 bp, Artificial Sequence
  Synthetic polynucleotide
cttggatgtacaggctctttccgtaaccaacg

SEQ ID NO: 815 - DNA, 48 bp, Artificial Sequence
  Synthetic polynucleotide
tctgcctactagcttgccgaaaaagttaccccaaagagctcaaagcgt

SEQ ID NO: 816 - DNA, 32 bp, Artificial Sequence
  Synthetic polynucleotide
atggatgcaccgaaaccaacacaaccaagctt

SEQ ID NO: 817 - DNA, 32 bp, Artificial Sequence
  Synthetic polynucleotide
ttttttttctgtggtcatcggacttttttttt

SEQ ID NO: 818 - DNA, 48 bp, Artificial Sequence
  Synthetic polynucleotide
agtctacgttttttttttttttttgggtagaagcctttcgtcaccttt

SEQ ID NO: 819 - DNA, 32 bp, Artificial Sequence
  Synthetic polynucleotide
ggattagctttggcagggtatgccacacacaa

SEQ ID NO: 820 - DNA, 48 bp, Artificial Sequence
  Synthetic polynucleotide
ctccatcgcctgtcagtgccactcaacgtgatctgacctgagagtgtc

SEQ ID NO: 821 - DNA, 32 bp, Artificial Sequence
  Synthetic polynucleotide
ataccaggatccgtttgcactcattggaggag

SEQ ID NO: 822 - DNA, 32 bp, Artificial Sequence
  Synthetic polynucleotide
tttttttttcaaggccagggtctatttttttt

SEQ ID NO: 823 - DNA, 48 bp, Artificial Sequence
  Synthetic polynucleotide
cacctagtttttttttttttttttgatgcacttgacgttatggtttga

SEQ ID NO: 824 - DNA, 32 bp, Artificial Sequence
  Synthetic polynucleotide
tcgaccactaacaacagttgtggagtaacgag

SEQ ID NO: 825 - DNA, 48 bp, Artificial Sequence
  Synthetic polynucleotide
gtgtctggacagcatccccctgatgtacaacgtgttccagcaacgtca

SEQ ID NO: 826 - DNA, 32 bp, Artificial Sequence
  Synthetic polynucleotide
ggttgccttctgtgttttccccatgtggagac

SEQ ID NO: 827 - DNA, 32 bp, Artificial Sequence
  Synthetic polynucleotide
ttttttttggttggatcaaagctgtttttttt

SEQ ID NO: 828 - DNA, 32 bp, Artificial Sequence
  Synthetic polynucleotide
tgcttgctttttttttttttttttgggatcag

SEQ ID NO: 829 - DNA, 32 bp, Artificial Sequence
  Synthetic polynucleotide
ttgctctccaaacgtattccggtaaggtgaga

SEQ ID NO: 830 - DNA, 32 bp, Artificial Sequence
  Synthetic polynucleotide
cagctcatgtgaccacaccagaagacccagtc

SEQ ID NO: 831 - DNA, 32 bp, Artificial Sequence
  Synthetic polynucleotide
aggctaggaccactttcgagggagatgctgaa

SEQ ID NO: 832 - DNA, 32 bp, Artificial Sequence
  Synthetic polynucleotide
ttttttttaagcactccctctccttttttttt

SEQ ID NO: 833 - DNA, 32 bp, Artificial Sequence
  Synthetic polynucleotide
aacgcttattttttttttttttttcttcagct

SEQ ID NO: 834 - DNA, 32 bp, Artificial Sequence
  Synthetic polynucleotide
gtcaaggtgacgattgagcagacataccgaat

SEQ ID NO: 835 - DNA, 32 bp, Artificial Sequence
  Synthetic polynucleotide
gattcatgcgaaaacggcaaaccggttgtttg

SEQ ID NO: 836 - DNA, 32 bp, Artificial Sequence
  Synthetic polynucleotide
gttctagcgactacggggacctgggaagtttg

SEQ ID NO: 837 - DNA, 32 bp, Artificial Sequence
  Synthetic polynucleotide
ttttttttatggagtgtcggtcagtttttttt

SEQ ID NO: 838 - DNA, 32 bp, Artificial Sequence
  Synthetic polynucleotide
ttcgaagctttttttttttttttttcatcagg

SEQ ID NO: 839 - DNA, 32 bp, Artificial Sequence
  Synthetic polynucleotide
tcacacagctctgctctatcaggaagacatgc

SEQ ID NO: 840 - DNA, 32 bp, Artificial Sequence
  Synthetic polynucleotide
gcctgtccggggacttatggtcgaatcctttg

SEQ ID NO: 841 - DNA, 32 bp, Artificial Sequence
  Synthetic polynucleotide
gaatgtgagtatcaatggagtctgtttcacag

SEQ ID NO: 842 - DNA, 32 bp, Artificial Sequence
  Synthetic polynucleotide
ttttttttctatgcactgtcaggttttttttt

SEQ ID NO: 843 - DNA, 32 bp, Artificial Sequence
  Synthetic polynucleotide
agtcaaggtttttttttttttttttaatgcca

SEQ ID NO: 844 - DNA, 32 bp, Artificial Sequence
  Synthetic polynucleotide
tatgagccgtggtaccccttttcgctgtctcc

SEQ ID NO: 845 - DNA, 32 bp, Artificial Sequence
  Synthetic polynucleotide
aatgtcgatacccccaaactcggttccagatg

SEQ ID NO: 846 - DNA, 32 bp, Artificial Sequence
  Synthetic polynucleotide
agtcgagcaggaggtgaaggctgtctaccaca

SEQ ID NO: 847 - DNA, 32 bp, Artificial Sequence
  Synthetic polynucleotide
tttttttttcaccgtttcaccatgtttttttt

SEQ ID NO: 848 - DNA, 32 bp, Artificial Sequence
  Synthetic polynucleotide
ccagaggtttttttttttttttttgctttgct

SEQ ID NO: 849 - DNA, 32 bp, Artificial Sequence
  Synthetic polynucleotide
catgaggcaactcgtttacgagcagagtgaag

SEQ ID NO: 850 - DNA, 32 bp, Artificial Sequence
  Synthetic polynucleotide
tcttcggatttacgctcccaaactgttgcctt

SEQ ID NO: 851 - DNA, 32 bp, Artificial Sequence
  Synthetic polynucleotide
agtccacaacacacgatcatgaactcgcctta

SEQ ID NO: 852 - DNA, 32 bp, Artificial Sequence
  Synthetic polynucleotide
tttttttttgcacatccttagccatttttttt

SEQ ID NO: 853 - DNA, 32 bp, Artificial Sequence
  Synthetic polynucleotide
cgaaaacattttttttttttttttgtactgct

SEQ ID NO: 854 - DNA, 32 bp, Artificial Sequence
  Synthetic polynucleotide
gggaggagactgaggtactactgggctagtgg

SEQ ID NO: 855 - DNA, 32 bp, Artificial Sequence
  Synthetic polynucleotide
gtacagtcattgggatttcgacatcacggaac

SEQ ID NO: 856 - DNA, 32 bp, Artificial Sequence
  Synthetic polynucleotide
actcgagagttttccgcaaggctacctaggtg

SEQ ID NO: 857 - DNA, 32 bp, Artificial Sequence
  Synthetic polynucleotide
ttttttttctactgtctgggtacgtttttttt

SEQ ID NO: 858 - DNA, 32 bp, Artificial Sequence
  Synthetic polynucleotide
caggttcgtttttttttttttttttgttgctc

SEQ ID NO: 859 - DNA, 48 bp, Artificial Sequence
  Synthetic polynucleotide
agtgtggaatgctgttaggcaagtaccatgtcgatcacccaatcacct

SEQ ID NO: 860 - DNA, 32 bp, Artificial Sequence
  Synthetic polynucleotide
agggaacaggaggtcaaggccttttcgaggta

SEQ ID NO: 861 - DNA, 48 bp, Artificial Sequence
  Synthetic polynucleotide
ctcctccaagctgaacccttccaacgaaaagctcagaagttttttttt

SEQ ID NO: 862 - DNA, 32 bp, Artificial Sequence
  Synthetic polynucleotide
ttttttttccggttgaggaaccagtttttttt

SEQ ID NO: 863 - DNA, 32 bp, Artificial Sequence
  Synthetic polynucleotide
acttggctttttttttttttttttgcgtagtc

SEQ ID NO: 864 - DNA, 48 bp, Artificial Sequence
  Synthetic polynucleotide
ccgaaatctcaatgcaggggactatctcttcgttccagaccacgagat

SEQ ID NO: 865 - DNA, 32 bp, Artificial Sequence
  Synthetic polynucleotide
gaggaggtccatgtacgcacacactcccttca

SEQ ID NO: 866 - DNA, 48 bp, Artificial Sequence
  Synthetic polynucleotide
atatggaggtcgaactcccatggaatgctcacaccaatcatttttttt

SEQ ID NO: 867 - DNA, 32 bp, Artificial Sequence
  Synthetic polynucleotide
ttttttttctgtcccgctccttggtttttttt

SEQ ID NO: 868 - DNA, 32 bp, Artificial Sequence
  Synthetic polynucleotide
catcgccattttttttttttttttcagtgtcg

SEQ ID NO: 869 - DNA, 48 bp, Artificial Sequence
  Synthetic polynucleotide
ggtcaatgtaccccaacgttcaacagagtacccctagagggcttggaa

SEQ ID NO: 870 - DNA, 32 bp, Artificial Sequence
  Synthetic polynucleotide
tttcccacgtctttggaaatccccgaaaccct

SEQ ID NO: 871 - DNA, 48 bp, Artificial Sequence
  Synthetic polynucleotide
tcccctcattgtcaggcaggatgacacaagttgcaggatttttttttt

SEQ ID NO: 872 - DNA, 32 bp, Artificial Sequence
  Synthetic polynucleotide
tttttttttcggctaaggtatggatttttttt

SEQ ID NO: 873 - DNA, 48 bp, Artificial Sequence
  Synthetic polynucleotide
caagaccctcgaaggatggaccacttttttttttttttttagtcaagc

SEQ ID NO: 874 - DNA, 48 bp, Artificial Sequence
  Synthetic polynucleotide
caggtacccgttgagtccgtacctcaaagctcatgttccataggttcg

SEQ ID NO: 875 - DNA, 32 bp, Artificial Sequence
  Synthetic polynucleotide
ttttttttcacagttccactggagtttttttt

SEQ ID NO: 876 - DNA, 16 bp, Artificial Sequence
  Synthetic polynucleotide
ttttttttcaaaccaa

SEQ ID NO: 877 - DNA, 48 bp, Artificial Sequence
  Synthetic polynucleotide
gtactgctcactgaggacgaaaagttttttttttttttttaacacccc

SEQ ID NO: 878 - DNA, 48 bp, Artificial Sequence
  Synthetic polynucleotide
ttacgggacaggactcgtagaggactacggttgaggtgagtgaatcgg

SEQ ID NO: 879 - DNA, 32 bp, Artificial Sequence
  Synthetic polynucleotide
ttttttttctacgcttcggttttgtttttttt

SEQ ID NO: 880 - DNA, 16 bp, Artificial Sequence
  Synthetic polynucleotide
ttttttttcagttcaa

SEQ ID NO: 881 - DNA, 48 bp, Artificial Sequence
  Synthetic polynucleotide
caggaacagtacacactaggactcttttttttttttttttatgttggg

SEQ ID NO: 882 - DNA, 48 bp, Artificial Sequence
  Synthetic polynucleotide
acgtatccggtaggggtatgcaaaccgttaagtcccagatctgacaga

SEQ ID NO: 883 - DNA, 32 bp, Artificial Sequence
  Synthetic polynucleotide
ttttttttgtgttccatgtctctttttttttt

SEQ ID NO: 884 - DNA, 16 bp, Artificial Sequence
  Synthetic polynucleotide
ttttttttacgtgtct

SEQ ID NO: 885 - DNA, 48 bp, Artificial Sequence
  Synthetic polynucleotide
ccaggttattttttttttttttttagtggctcaatcatactcacggtt

SEQ ID NO: 886 - DNA, 32 bp, Artificial Sequence; identical to SEQ ID NO: 3
  Synthetic polynucleotide

SEQ ID NO: 887 - DNA, 48 bp, Artificial Sequence
  Synthetic polynucleotide
tacgaactcaacgcacgctcgggtagtctcaagaagatagagagcata

SEQ ID NO: 888 - DNA, 32 bp, Artificial Sequence
  Synthetic polynucleotide
aattcgctaaaccggaaaagtatccgcatctc

SEQ ID NO: 889 - DNA, 48 bp, Artificial Sequence
  Synthetic polynucleotide
actcagtgatcgagtattcatgtcgccttttcgaacggtgacacactt

SEQ ID NO: 890 - DNA, 32 bp, Artificial Sequence; identical to SEQ ID NO: 8
  Synthetic polynucleotide

SEQ ID NO: 891 - DNA, 48 bp, Artificial Sequence
  Synthetic polynucleotide
ttcggtgcgcagcgggccgcctgtaacgcttaatcagcccgggctttt

SEQ ID NO: 892 - DNA, 32 bp, Artificial Sequence
  Synthetic polynucleotide
gctaatacgctgagcgatgctgttgttgcggg

SEQ ID NO: 893 - DNA, 48 bp, Artificial Sequence
  Synthetic polynucleotide
gtttctgaaccggaacccgggctattttttttttttttttatgaagcc

SEQ ID NO: 894 - DNA, 48 bp, Artificial Sequence; identical to SEQ ID NO: 97
  Synthetic polynucleotide

SEQ ID NO: 895 - DNA, 48 bp, Artificial Sequence
  Synthetic polynucleotide
gtcagtgtgatcgcgagttccctctagctagggtgatgccaaaagggt

SEQ ID NO: 896 - DNA, 48 bp, Artificial Sequence; identical to SEQ ID NO: 105
  Synthetic polynucleotide

SEQ ID NO: 897 - DNA, 16 bp, Artificial Sequence
  Synthetic polynucleotide
ttttttttcggagcta

SEQ ID NO: 898 - DNA, 32 bp, Artificial Sequence
  Synthetic polynucleotide
cctgacctttttttttttttttttcaatcata

SEQ ID NO: 899 - DNA, 48 bp, Artificial Sequence
  Synthetic polynucleotide
cgtcccacggaaggattcatcccctttaagaatgatcgcacagtcttt

SEQ ID NO: 900 - DNA, 32 bp, Artificial Sequence
  Synthetic polynucleotide
gagatgttgaacatcttttggttggcgtaaag

SEQ ID NO: 901 - DNA, 48 bp, Artificial Sequence
  Synthetic polynucleotide
atctcgcattctggtgccaaaactgccgactcgttcaagcactattat

SEQ ID NO: 902 - DNA, 32 bp, Artificial Sequence
  Synthetic polynucleotide
ctggctataaaagatgtctgtcagcccaagct

SEQ ID NO: 903 - DNA, 48 bp, Artificial Sequence
  Synthetic polynucleotide
tagcataagcggctggacgaccccgccgtgcgacgactgaccgtcgag

SEQ ID NO: 904 - DNA, 32 bp, Artificial Sequence
  Synthetic polynucleotide
ccctgcgcgacaaacgcatatcctcggcccgc

SEQ ID NO: 905 - DNA, 32 bp, Artificial Sequence
  Synthetic polynucleotide
caaattaatagtcgattacgcttcgcctaaag

SEQ ID NO: 906 - DNA, 16 bp, Artificial Sequence
  Synthetic polynucleotide
gtccttcctttttttt

SEQ ID NO: 907 - DNA, 48 bp, Artificial Sequence
  Synthetic polynucleotide
acggtaatcgggggtgactccggcctccttggtatattagcttaccca

SEQ ID NO: 908 - DNA, 48 bp, Artificial Sequence
  Synthetic polynucleotide
ctcgcgtggcacgtctacgactcgtcgaacgaggactgttctacatag

SEQ ID NO: 909 - DNA, 48 bp, Artificial Sequence
  Synthetic polynucleotide
tgacttggacgaggtttcactgggcgctatacaggaaactcgaggggc

SEQ ID NO: 910 - DNA, 32 bp, Artificial Sequence; identical to SEQ ID NO: 35
  Synthetic polynucleotide

SEQ ID NO: 911 - DNA, 48 bp, Artificial Sequence
  Synthetic polynucleotide
gagaaagatttttttttttttttttgcggtggcagtagttgtgattag

SEQ ID NO: 912 - DNA, 32 bp, Artificial Sequence; identical to SEQ ID NO: 37
  Synthetic polynucleotide

SEQ ID NO: 913 - DNA, 48 bp, Artificial Sequence
  Synthetic polynucleotide
taatgtgactaagcgttaactccaaaggaaaccagctatcccatattc

SEQ ID NO: 914 - DNA, 32 bp, Artificial Sequence
  Synthetic polynucleotide
gatgtaagcggacatctatgcgcccgatatcc

SEQ ID NO: 915 - DNA, 48 bp, Artificial Sequence; identical to SEQ ID NO: 149
  Synthetic polynucleotide

SEQ ID NO: 916 - DNA, 32 bp, Artificial Sequence; identical to SEQ ID NO: 370
  Synthetic polynucleotide

SEQ ID NO: 917 - DNA, 48 bp, Artificial Sequence; identical to SEQ ID NO: 371
  Synthetic polynucleotide

SEQ ID NO: 918 - DNA, 32 bp, Artificial Sequence
  Synthetic polynucleotide
gatcgtcattgggatatacaatctcgaagtaa

SEQ ID NO: 919 - DNA, 48 bp, Artificial Sequence
  Synthetic polynucleotide
agcatagcaccctgcgaagataggttttttttttttttttgtcacagc

SEQ ID NO: 920 - DNA, 48 bp, Artificial Sequence
  Synthetic polynucleotide
agtaatacctctaccttgttggacgtaagcgtgaaataacgaccagaa

SEQ ID NO: 921 - DNA, 48 bp, Artificial Sequence
  Synthetic polynucleotide
agcacgaggattatcacgtgtacctcgaaataatcgttagtttctcga

SEQ ID NO: 922 - DNA, 48 bp, Artificial Sequence
  Synthetic polynucleotide
ctgttccgaaacaggcagcggtagcctcccacttaacctatgccttgg

SEQ ID NO: 923 - DNA, 16 bp, Artificial Sequence
  Synthetic polynucleotide
tttttttttaactgat

SEQ ID NO: 924 - DNA, 32 bp, Artificial Sequence
  Synthetic polynucleotide
tttctcctttttttttttttttttggttccgc

SEQ ID NO: 925 - DNA, 48 bp, Artificial Sequence
  Synthetic polynucleotide
tagctgatctatggtccttaatataaccctcggaggcaaggggagagg

SEQ ID NO: 926 - DNA, 32 bp, Artificial Sequence
  Synthetic polynucleotide
gtgaaacaggccacctggctcggggagtgccc

SEQ ID NO: 927 - DNA, 48 bp, Artificial Sequence
  Synthetic polynucleotide
cctcggcagccgcctcggttatactcgtcaagcctgctttccatagct

SEQ ID NO: 928 - DNA, 32 bp, Artificial Sequence
  Synthetic polynucleotide
aacccgattgtgcattccacgtgagtcgtact

SEQ ID NO: 929 - DNA, 48 bp, Artificial Sequence
  Synthetic polynucleotide
taaagcaaacgtgggagtgcccgagcgtctgaggtatggtttacccac

SEQ ID NO: 930 - DNA, 32 bp, Artificial Sequence
  Synthetic polynucleotide
tatgttgtctcaagtgctaacagtactaatta

SEQ ID NO: 931 - DNA, 32 bp, Artificial Sequence
  Synthetic polynucleotide
tccataactgtgcacgtcagggattctcaccg

SEQ ID NO: 932 - DNA, 16 bp, Artificial Sequence
  Synthetic polynucleotide
gtggccgttttttttt

SEQ ID NO: 933 - DNA, 48 bp, Artificial Sequence
  Synthetic polynucleotide
tgctacatcagtttctttgcactcctggggaaactatacttacgcact

SEQ ID NO: 934 - DNA, 48 bp, Artificial Sequence
  Synthetic polynucleotide
ggtttggagggattaggcaattgctaggttgcattgtaggcacaattt

SEQ ID NO: 935 - DNA, 48 bp, Artificial Sequence
  Synthetic polynucleotide
ttgattcgatcacatacatgggcaataaagctgtagcctgaggcgcgc

SEQ ID NO: 936 - DNA, 32 bp, Artificial Sequence
  Synthetic polynucleotide
agctgcaccgtgtcaccttgatattgagggac

SEQ ID NO: 937 - DNA, 48 bp, Artificial Sequence
  Synthetic polynucleotide
acctcgtcttttttttttttttttattcggataaaccatactgagggc

SEQ ID NO: 938 - DNA, 32 bp, Artificial Sequence; identical to SEQ ID NO: 73
  Synthetic polynucleotide

SEQ ID NO: 939 - DNA, 48 bp, Artificial Sequence
  Synthetic polynucleotide
cttagttagttcatagttcattaggggcggaaatgggctggtgcccca

SEQ ID NO: 940 - DNA, 32 bp, Artificial Sequence
  Synthetic polynucleotide
cgtacagtaaccaaccggtgtacctgtgggta

SEQ ID NO: 941 - DNA, 48 bp, Artificial Sequence
  Synthetic polynucleotide
gggccgagcgctgggcttacatgtgcaagtgaaatatatgacttggtc

SEQ ID NO: 942 - DNA, 32 bp, Artificial Sequence; identical to SEQ ID NO: 78
  Synthetic polynucleotide

SEQ ID NO: 943 - DNA, 48 bp, Artificial Sequence
  Synthetic polynucleotide
cttgacacctttcaatttttagtaaacacccaacagagctgaacttcc

SEQ ID NO: 944 - DNA, 32 bp, Artificial Sequence
  Synthetic polynucleotide
catggtcgttctactgtcgtatgatcatagga

SEQ ID NO: 945 - DNA, 48 bp, Artificial Sequence
  Synthetic polynucleotide
tcaaactaaatacagcgtaccgccttttttttttttttttagttcttg

SEQ ID NO: 946 - DNA, 48 bp, Artificial Sequence
  Synthetic polynucleotide
tccttattggcgatcgtgcattccaatgtttgatggccgcgtggctta

SEQ ID NO: 947 - DNA, 48 bp, Artificial Sequence; identical to SEQ ID NO: 403
  Synthetic polynucleotide

SEQ ID NO: 948 - DNA, 48 bp, Artificial Sequence
  Synthetic polynucleotide
acgcggaacgtaatggcagaaagtctatacccgacaaaaacagatttg

SEQ ID NO: 949 - DNA, 16 bp, Artificial Sequence
  Synthetic polynucleotide
tttttttttaccgggg

SEQ ID NO: 950 - DNA, 32 bp, Artificial Sequence
  Synthetic polynucleotide
tgaacagcttttttttttttttttacgtgcgg

SEQ ID NO: 951 - DNA, 48 bp, Artificial Sequence
  Synthetic polynucleotide
cttctcctgtatcgccttgtgtattatactcttgcgggggggtcgagc

SEQ ID NO: 952 - DNA, 32 bp, Artificial Sequence
  Synthetic polynucleotide
gctccactgtagtggccggccatcgtggacta

SEQ ID NO: 953 - DNA, 48 bp, Artificial Sequence
  Synthetic polynucleotide
gaaagcgccggcaatctgaatatcgctacctccgatacgcgaaccaga

SEQ ID NO: 954 - DNA, 32 bp, Artificial Sequence
  Synthetic polynucleotide
accatttaagagtaggggcagtgctcagccaa

SEQ ID NO: 955 - DNA, 48 bp, Artificial Sequence
  Synthetic polynucleotide
acagtgggacatctcggaaaggtgtcccaagtgcaagtaaaaaaggaa

SEQ ID NO: 956 - DNA, 32 bp, Artificial Sequence
  Synthetic polynucleotide
ttatgagatcatgtgggatcctaaagtttctg

SEQ ID NO: 957 - DNA, 32 bp, Artificial Sequence
  Synthetic polynucleotide
gtagacctcgtaggctagagcggtgatatcca

SEQ ID NO: 958 - DNA, 16 bp, Artificial Sequence
  Synthetic polynucleotide
cggtacattttttttt

SEQ ID NO: 959 - DNA, 48 bp, Artificial Sequence
  Synthetic polynucleotide
tcgtttactgcacggaacgagagtgctggcataagcaagagaaaccta

SEQ ID NO: 960 - DNA, 48 bp, Artificial Sequence
  Synthetic polynucleotide
acttggggactaagatcgttgcgaattttcgcgcgattcgcatgtagc

SEQ ID NO: 961 - DNA, 48 bp, Artificial Sequence
  Synthetic polynucleotide
cgaacgagatcgtcctagacgacggatctcctgcatgccggtagcacc

SEQ ID NO: 962 - DNA, 32 bp, Artificial Sequence; identical to SEQ ID NO: 419
  Synthetic polynucleotide

SEQ ID NO: 963 - DNA, 48 bp, Artificial Sequence
  Synthetic polynucleotide
cagcttgattttttttttttttttcgcaagacgctaatcactgggcag

SEQ ID NO: 964 - DNA, 32 bp, Artificial Sequence; identical to SEQ ID NO: 422
  Synthetic polynucleotide

SEQ ID NO: 965 - DNA, 48 bp, Artificial Sequence
  Synthetic polynucleotide
agcgtagtaagggttacaagttcctgcggcggctgtacgaatgagtcc

SEQ ID NO: 966 - DNA, 32 bp, Artificial Sequence
  Synthetic polynucleotide
ggccttgacatgacattctcccacccgtccaa

SEQ ID NO: 967 - DNA, 48 bp, Artificial Sequence
  Synthetic polynucleotide
caccagcaggatgtcgagcccacaacttgacagtagtacagtatcttt

SEQ ID NO: 968 - DNA, 32 bp, Artificial Sequence
  Synthetic polynucleotide
tttcatggcggcgatgtcgccgtttgctcgcg

SEQ ID NO: 969 - DNA, 48 bp, Artificial Sequence
  Synthetic polynucleotide
tgcgtacggcttttatatagcgtagaccggacaaccccgtaaatcgta

SEQ ID NO: 970 - DNA, 32 bp, Artificial Sequence
  Synthetic polynucleotide
agagtcgttatgccccccggttctgctagagt

SEQ ID NO: 971 - DNA, 48 bp, Artificial Sequence
  Synthetic polynucleotide
gggactggatcagatgttcaagtattttttttttttttttttcggtga

SEQ ID NO: 972 - DNA, 48 bp, Artificial Sequence
  Synthetic polynucleotide
cctccccgcattacaacgcgcttaccaagtaacgtatgtacgacgcga

SEQ ID NO: 973 - DNA, 48 bp, Artificial Sequence
  Synthetic polynucleotide
tgcgagtgaacgggtggatgaatttcgttcggggccaggcgatctaag

SEQ ID NO: 974 - DNA, 48 bp, Artificial Sequence
  Synthetic polynucleotide
tctggcgcgtgaggacacgtaagttgaagtaggaagctttttctagcc

SEQ ID NO: 975 - DNA, 16 bp, Artificial Sequence
  Synthetic polynucleotide
ttttttttatagcatc

SEQ ID NO: 976 - DNA, 32 bp, Artificial Sequence
  Synthetic polynucleotide
gacactacttttttttttttttttgacctgct

SEQ ID NO: 977 - DNA, 48 bp, Artificial Sequence
  Synthetic polynucleotide
tttcgacacggactgcattctggacagtaactgcattaactacgtgct

SEQ ID NO: 978 - DNA, 32 bp, Artificial Sequence
  Synthetic polynucleotide
cccaacataagtgacgtcctcagcagttgaaa

SEQ ID NO: 979 - DNA, 48 bp, Artificial Sequence
  Synthetic polynucleotide
attatctcgataagcagaaggacctgtataactggcaagagacaaggc

SEQ ID NO: 980 - DNA, 32 bp, Artificial Sequence
  Synthetic polynucleotide
cgcttcagaaaggatagccggaccgtattaat

SEQ ID NO: 981 - DNA, 48 bp, Artificial Sequence
  Synthetic polynucleotide
gccgcgccaacggtttcccggacctagtgtctatcaagtctattctat

SEQ ID NO: 982 - DNA, 32 bp, Artificial Sequence
  Synthetic polynucleotide
gaaaccattctcgggtcgagcgggtcactgtt

SEQ ID NO: 983 - DNA, 32 bp, Artificial Sequence
  Synthetic polynucleotide
gtgacctacgagaagcgtatagatgttccgcg

SEQ ID NO: 984 - DNA, 16 bp, Artificial Sequence
  Synthetic polynucleotide
cgaatagctttttttt

SEQ ID NO: 985 - DNA, 48 bp, Artificial Sequence
  Synthetic polynucleotide
tcacaggcgaactacgtatgaattggtttaaacgctcctcgggaatta

SEQ ID NO: 986 - DNA, 48 bp, Artificial Sequence
  Synthetic polynucleotide
atacgacaggtggcaaaccacctccgatgtcagcgccgcatacccatt

SEQ ID NO: 987 - DNA, 48 bp, Artificial Sequence
  Synthetic polynucleotide
cactgtgaatttccacaccgaggattcgcaggtccatgggattcacca

SEQ ID NO: 988 - DNA, 32 bp, Artificial Sequence
  Synthetic polynucleotide
agctcgtatacaccctgattctccatggcagc

SEQ ID NO: 989 - DNA, 48 bp, Artificial Sequence
  Synthetic polynucleotide
gcttcggtttttttttttttttttacaggtctgaactggtagatcacc

SEQ ID NO: 990 - DNA, 32 bp, Artificial Sequence
  Synthetic polynucleotide
attagtgtacccagcagttcggctcccttgtg

SEQ ID NO: 991 - DNA, 48 bp, Artificial Sequence
  Synthetic polynucleotide
gactcgggatacccggtcgtcgtgtaatgctgttccggggtaaatcaa

SEQ ID NO: 992 - DNA, 32 bp, Artificial Sequence
  Synthetic polynucleotide
gctttataaattcccgacgctctgttccaaac

SEQ ID NO: 993 - DNA, 48 bp, Artificial Sequence
  Synthetic polynucleotide
tttagagcccggccgtaatctcggattccttaaaaaccaggcgcaatc

SEQ ID NO: 994 - DNA, 32 bp, Artificial Sequence
  Synthetic polynucleotide
tcatggcataaacgaaacccaatcatacgagc

SEQ ID NO: 995 - DNA, 48 bp, Artificial Sequence
  Synthetic polynucleotide
gtggagggaagttattctactggcgttttcatatatcagagagcacag

SEQ ID NO: 996 - DNA, 32 bp, Artificial Sequence
  Synthetic polynucleotide
taattcggagcccggcgtattatcgcgtcaat

SEQ ID NO: 997 - DNA, 48 bp, Artificial Sequence
  Synthetic polynucleotide
tcatatggacacaccagattacggttttttttttttttttcggcttag

SEQ ID NO: 998 - DNA, 48 bp, Artificial Sequence
  Synthetic polynucleotide
gggaattgagtacaagtgacgaagaataccgtccatcagatggagctg

SEQ ID NO: 999 - DNA, 48 bp, Artificial Sequence
  Synthetic polynucleotide
tcaggcttctccgtcaaaatgttggctgagattgattggtttagtgta

SEQ ID NO: 1000 - DNA, 48 bp, Artificial Sequence
  Synthetic polynucleotide
tagcgagtaagagatatgtgggaggatcattacaggatcaaagttgac

SEQ ID NO: 1001 - DNA, 16 bp, Artificial Sequence
  Synthetic polynucleotide
tttttttttagcagaa

SEQ ID NO: 1002 - DNA, 32 bp, Artificial Sequence
  Synthetic polynucleotide
taatttgcttttttttttttttttatccgaat

SEQ ID NO: 1003 - DNA, 48 bp, Artificial Sequence
  Synthetic polynucleotide
aaggtacgcaattactatttgtaccgaaaacaagggcatacagtaacg

SEQ ID NO: 1004 - DNA, 32 bp, Artificial Sequence
  Synthetic polynucleotide
aaaagcgaacgagccaccacctagcacctcct

SEQ ID NO: 1005 - DNA, 48 bp, Artificial Sequence
  Synthetic polynucleotide
gttagggtgacacccgggatgggttgttcatcggtcaccccagttttc

SEQ ID NO: 1006 - DNA, 32 bp, Artificial Sequence
  Synthetic polynucleotide
gcttgaggaatagtccaagaaatgcatgataa

SEQ ID NO: 1007 - DNA, 48 bp, Artificial Sequence
  Synthetic polynucleotide
aagttgtgccgcactggaatctgaagatgcaccggttctcgagacact

SEQ ID NO: 1008 - DNA, 32 bp, Artificial Sequence
  Synthetic polynucleotide
catttactgctcggtagaccatgtctccagta

SEQ ID NO: 1009 - DNA, 32 bp, Artificial Sequence
  Synthetic polynucleotide
ttgccattttctaattaatacttttaatataa

SEQ ID NO: 1010 - DNA, 16 bp, Artificial Sequence
  Synthetic polynucleotide
tgtccgcgtttttttt

SEQ ID NO: 1011 - DNA, 48 bp, Artificial Sequence
  Synthetic polynucleotide
gatcagcgaattcgacacaatggtatcttttgaagcgcacgtaaaccg

SEQ ID NO: 1012 - DNA, 48 bp, Artificial Sequence
  Synthetic polynucleotide
cttgcctgggccaatactttgtggtccactatatataggtctgacacc

SEQ ID NO: 1013 - DNA, 48 bp, Artificial Sequence
  Synthetic polynucleotide
cagctcccaggtaagtgcggagagaaatggctaatggtcgacaatatg

SEQ ID NO: 1014 - DNA, 32 bp, Artificial Sequence
  Synthetic polynucleotide
tattaagttttcgccgtgagcgatcaatgacc

SEQ ID NO: 1015 - DNA, 48 bp, Artificial Sequence
  Synthetic polynucleotide
ccagtaatttttttttttttttttagcctgaacaccctgcatcgacgg

SEQ ID NO: 1016 - DNA, 32 bp, Artificial Sequence
  Synthetic polynucleotide
cttctacctcttaatgtataattcatcctgtg

SEQ ID NO: 1017 - DNA, 48 bp, Artificial Sequence
  Synthetic polynucleotide
catggaagcagagttcccatcggcaaaattgagttaccgctataatta

SEQ ID NO: 1018 - DNA, 32 bp, Artificial Sequence
  Synthetic polynucleotide
agaacattcgggttcgacgtggtctatgtgat

SEQ ID NO: 1019 - DNA, 48 bp, Artificial Sequence
  Synthetic polynucleotide
cgcctaggctaacctcatgactccaggagagggtgagctcctacgtgg

SEQ ID NO: 1020 - DNA, 32 bp, Artificial Sequence
  Synthetic polynucleotide
aagtgttaatgccgagatctaacttgattttt

SEQ ID NO: 1021 - DNA, 48 bp, Artificial Sequence
  Synthetic polynucleotide
attcagaatcgagaccttgctcttggacgtctcattctatagcccgcg

SEQ ID NO: 1022 - DNA, 32 bp, Artificial Sequence
  Synthetic polynucleotide
gttactaggcgccttgctcctacgctcaatag

SEQ ID NO: 1023 - DNA, 48 bp, Artificial Sequence
  Synthetic polynucleotide
tgaacccttactatcgcgacaggatttttttttttttttttaggtcaa

SEQ ID NO: 1024 - DNA, 48 bp, Artificial Sequence
  Synthetic polynucleotide
aataaacgatacttaaagctctagaggggaaccgtagacttcacataa

SEQ ID NO: 1025 - DNA, 48 bp, Artificial Sequence
  Synthetic polynucleotide
aaaacactcggcgagtgttctagggagcggggatggtacacccagcat

SEQ ID NO: 1026 - DNA, 48 bp, Artificial Sequence
  Synthetic polynucleotide
tccttcagtccgcctactcatgatctttgatattctcccaaatggata

SEQ ID NO: 1027 - DNA, 16 bp, Artificial Sequence
  Synthetic polynucleotide
ttttttttgggcgtaa

SEQ ID NO: 1028 - DNA, 32 bp, Artificial Sequence
  Synthetic polynucleotide
acaaaaaattttttttttttttttcttgccta

SEQ ID NO: 1029 - DNA, 48 bp, Artificial Sequence
  Synthetic polynucleotide
tcgtgccctcatacagcattgtctaccacctatgttcttatgctgtta

SEQ ID NO: 1030 - DNA, 32 bp, Artificial Sequence
  Synthetic polynucleotide
acatagatcgtcgggcgaccttcgtaaggtgg

SEQ ID NO: 1031 - DNA, 48 bp, Artificial Sequence
  Synthetic polynucleotide
ggccgaccaccgaccaaggcgctatagggtatactcgtaagcgatatc

SEQ ID NO: 1032 - DNA, 32 bp, Artificial Sequence
  Synthetic polynucleotide
tgaatgcgtaatacgaaacgacaaaaaatacc

SEQ ID NO: 1033 - DNA, 48 bp, Artificial Sequence
  Synthetic polynucleotide
ttcgccggtccgtccgttggagcccacgaaccaacgcatccttagtgc

SEQ ID NO: 1034 - DNA, 32 bp, Artificial Sequence
  Synthetic polynucleotide
tgtagtttaccattaccggaggcgcattaggt

SEQ ID NO: 1035 - DNA, 32 bp, Artificial Sequence
  Synthetic polynucleotide
ctattataatgggacgccactacgtatcgttc

SEQ ID NO: 1036 - DNA, 16 bp, Artificial Sequence
  Synthetic polynucleotide
tataaaattttttttt

SEQ ID NO: 1037 - DNA, 48 bp, Artificial Sequence
  Synthetic polynucleotide
ggcactgtcacggcgcctttcagtgtgagtgtgatgacctcgcagcct

SEQ ID NO: 1038 - DNA, 48 bp, Artificial Sequence
  Synthetic polynucleotide
ggcacagcttggcgatatatcatctacaatgtgtctgacccttcacat

SEQ ID NO: 1039 - DNA, 48 bp, Artificial Sequence
  Synthetic polynucleotide
taatatggggattacccttcaataagttgtaggcatcagctggcaggt

SEQ ID NO: 1040 - DNA, 32 bp, Artificial Sequence
  Synthetic polynucleotide
gccatcctacccgctttctcatgcgaagcagg

SEQ ID NO: 1041 - DNA, 48 bp, Artificial Sequence
  Synthetic polynucleotide
acccgagcaaccgtgagtatgattgagccactggaaggacccaaggag

SEQ ID NO: 1042 - DNA, 48 bp, Artificial Sequence
  Synthetic polynucleotide
gacatgaatatgctctctatcttcttgagactattaccgttcgttcga

SEQ ID NO: 1043 - DNA, 48 bp, Artificial Sequence
  Synthetic polynucleotide
acaggcggaagtgtgtcaccgttcgaaaaggccacgcgaggtatagcg

SEQ ID NO: 1044 - DNA, 48 bp, Artificial Sequence
  Synthetic polynucleotide
ttttttttaaaagcccgggctgattaagcgttccaagtcagctcgaca

SEQ ID NO: 1045 - DNA, 16 bp, Artificial Sequence
  Synthetic polynucleotide
taacctggataggaca

SEQ ID NO: 1046 - DNA, 48 bp, Artificial Sequence
  Synthetic polynucleotide
gtggctggccatccctaagtaaacggcttcataggtcaggatccttcc

SEQ ID NO: 1047 - DNA, 48 bp, Artificial Sequence
  Synthetic polynucleotide
ggcatcacgagatgcggatactttacagctaaaacatctccaccagaa

SEQ ID NO: 1048 - DNA, 48 bp, Artificial Sequence
  Synthetic polynucleotide
ccaggtcagcggccatatttccgcacccttttatagccagccagccgc

SEQ ID NO: 1049 - DNA, 48 bp, Artificial Sequence
  Synthetic polynucleotide
ttttttttcccgcaacaacagcatccattatagcgcagggatcgacta

SEQ ID NO: 1050 - DNA, 16 bp, Artificial Sequence
  Synthetic polynucleotide
tagcccgggttccggt

SEQ ID NO: 1051 - DNA, 32 bp, Artificial Sequence
  Synthetic polynucleotide
ggggatgatagctccgcctatcttcgcagggt

SEQ ID NO: 1052 - DNA, 48 bp, Artificial Sequence
  Synthetic polynucleotide
tgcgatcattcttaaatcagaaacctcccggtgcatcagacagtctct

SEQ ID NO: 1053 - DNA, 32 bp, Artificial Sequence
  Synthetic polynucleotide
agttttggaaagactggtccaacaaggtagag

SEQ ID NO: 1054 - DNA, 48 bp, Artificial Sequence
  Synthetic polynucleotide
gcttgaacgagtcggcggggtcaccctagctagagggaactcgcgatc

SEQ ID NO: 1055 - DNA, 32 bp, Artificial Sequence
  Synthetic polynucleotide
ggggtcgtataatagtggtacacgtgataatc

SEQ ID NO: 1056 - DNA, 48 bp, Artificial Sequence
  Synthetic polynucleotide
tcagtcgtcgcacggcacactgacctagaaatcagagccgttccagct

SEQ ID NO: 1057 - DNA, 32 bp, Artificial Sequence
  Synthetic polynucleotide
gaagcgtactcgacggctaccgctgcctgttt

SEQ ID NO: 1058 - DNA, 32 bp, Artificial Sequence
  Synthetic polynucleotide
ttttttttctttaggcccatatcctttttttt

SEQ ID NO: 1059 - DNA, 32 bp, Artificial Sequence
  Synthetic polynucleotide
ctaatatatatgattgtctttctcgtatatca

SEQ ID NO: 1060 - DNA, 48 bp, Artificial Sequence
  Synthetic polynucleotide
caaccaaatgggtaagcaacagttgtgcgttgagttcgtatccggttt

SEQ ID NO: 1061 - DNA, 32 bp, Artificial Sequence
  Synthetic polynucleotide
aacagtccctttacgctcacattagatgtccg

SEQ ID NO: 1062 - DNA, 48 bp, Artificial Sequence
  Synthetic polynucleotide
ctgacagactatgtagagcgaatttactcgatcactgagttactctga

SEQ ID NO: 1063 - DNA, 32 bp, Artificial Sequence
  Synthetic polynucleotide
agtttcctagcttggggtttgaacctgctcta

SEQ ID NO: 1064 - DNA, 48 bp, Artificial Sequence
  Synthetic polynucleotide
aggatatggcccctcgatgaacaccccgctgcgcaccgaacgctcagc

SEQ ID NO: 1065 - DNA, 32 bp, Artificial Sequence
  Synthetic polynucleotide
gtcgctgggcgggccgcataggtatatcccaa

SEQ ID NO: 1066 - DNA, 32 bp, Artificial Sequence
  Synthetic polynucleotide
ttttttttcagaagtggtattagctttttttt

SEQ ID NO: 1067 - DNA, 32 bp, Artificial Sequence
  Synthetic polynucleotide
aactactgccaccgcaacggccacttccccag

SEQ ID NO: 1068 - DNA, 32 bp, Artificial Sequence
  Synthetic polynucleotide
tggagttactaatcacgccggagtcacccccg

SEQ ID NO: 1069 - DNA, 32 bp, Artificial Sequence
  Synthetic polynucleotide
gatagctggtttccttatgtagcagcaaccta

SEQ ID NO: 1070 - DNA, 32 bp, Artificial Sequence
  Synthetic polynucleotide
ggtcagaagaatatggcgagtcgtagacgtgc

SEQ ID NO: 1071 - DNA, 32 bp, Artificial Sequence
  Synthetic polynucleotide
aattctcatgagcttttccaaaccagctttat

SEQ ID NO: 1072 - DNA, 32 bp, Artificial Sequence
  Synthetic polynucleotide
gtcgcatactgtttaccccagtgaaacctcgt

SEQ ID NO: 1073 - DNA, 32 bp, Artificial Sequence
  Synthetic polynucleotide
tcatccggatcatggtcgaatcaagtgacacg

SEQ ID NO: 1074 - DNA, 32 bp, Artificial Sequence
  Synthetic polynucleotide
ttttttttttcataacgacagggatttttttt

SEQ ID NO: 1075 - DNA, 32 bp, Artificial Sequence
  Synthetic polynucleotide
ttagtgaggctgtgacaggagaaagaccatag

SEQ ID NO: 1076 - DNA, 32 bp, Artificial Sequence
  Synthetic polynucleotide
gttatttcgaaggagtgtgggacgagatgttc

SEQ ID NO: 1077 - DNA, 32 bp, Artificial Sequence
  Synthetic polynucleotide
ggcgcatattctggtctgtttcacgaggcggc

SEQ ID NO: 1078 - DNA, 32 bp, Artificial Sequence
  Synthetic polynucleotide
ctaacgatggatatcgtgcgagatcatctttt

SEQ ID NO: 1079 - DNA, 32 bp, Artificial Sequence
  Synthetic polynucleotide
gaacttgatcgagaaaatcgggtttcccacgt

SEQ ID NO: 1080 - DNA, 32 bp, Artificial Sequence
  Synthetic polynucleotide
taggttaagcgtatccttatgctacgtttgtc

SEQ ID NO: 1081 - DNA, 32 bp, Artificial Sequence
  Synthetic polynucleotide
agattgtaccaaggcaacaacatacgtgcaca

SEQ ID NO: 1082 - DNA, 32 bp, Artificial Sequence
  Synthetic polynucleotide
ttttttttttacttcgttaatttgtttttttt

SEQ ID NO: 1083 - DNA, 32 bp, Artificial Sequence
  Synthetic polynucleotide
atattaagatcagttaggcggtacgctgtatt

SEQ ID NO: 1084 - DNA, 32 bp, Artificial Sequence
  Synthetic polynucleotide
cttgcctccgagggttgctatgctacgcttac

SEQ ID NO: 1085 - DNA, 32 bp, Artificial Sequence
  Synthetic polynucleotide
gtataacccctctcccggaatgcacgatcgcc

SEQ ID NO: 1086 - DNA, 32 bp, Artificial Sequence
  Synthetic polynucleotide
aaagcaggcttgacgagtattacttatttcga

SEQ ID NO: 1087 - DNA, 32 bp, Artificial Sequence
  Synthetic polynucleotide
tcgggcacagctatggatgtggttacaccggc

SEQ ID NO: 1088 - DNA, 32 bp, Artificial Sequence
  Synthetic polynucleotide
accatacctcagacgcctcgtgctgtgggagg

SEQ ID NO: 1089 - DNA, 32 bp, Artificial Sequence
  Synthetic polynucleotide
atccctgagtgggtaaactttctgccattacg

SEQ ID NO: 1090 - DNA, 32 bp, Artificial Sequence
  Synthetic polynucleotide
ttttttttcggtgagacggaacagtttttttt

SEQ ID NO: 1091 - DNA, 32 bp, Artificial Sequence
  Synthetic polynucleotide
agtatagtgcggaaccgacgaggtgccgatct

SEQ ID NO: 1092 - DNA, 32 bp, Artificial Sequence
  Synthetic polynucleotide
cccgagccagtgcgtacccccaagacgcttag

SEQ ID NO: 1093 - DNA, 32 bp, Artificial Sequence
  Synthetic polynucleotide
cctacaatgggcactctaactaagggttggtt

SEQ ID NO: 1094 - DNA, 32 bp, Artificial Sequence
  Synthetic polynucleotide
tcacgtggaaattgtgcttacatcgcccccta

SEQ ID NO: 1095 - DNA, 32 bp, Artificial Sequence
  Synthetic polynucleotide
caggctacagtacgacctcggccctctagcag

SEQ ID NO: 1096 - DNA, 32 bp, Artificial Sequence
  Synthetic polynucleotide
actgttaggcgcgcctagctgttctccccgtc

SEQ ID NO: 1097 - DNA, 32 bp, Artificial Sequence
  Synthetic polynucleotide
atatcaagtaattagtgtgtcaagcagtagaa

SEQ ID NO: 1098 - DNA, 32 bp, Artificial Sequence
  Synthetic polynucleotide
ttttttttgtccctcatgacgatctttttttt

SEQ ID NO: 1099 - DNA, 32 bp, Artificial Sequence
  Synthetic polynucleotide
tatggtttatccgaatatgtaccgatgccagc

SEQ ID NO: 1100 - DNA, 32 bp, Artificial Sequence
  Synthetic polynucleotide
ctaatgaagccctcaggagtgcaaagaaactg

SEQ ID NO: 1101 - DNA, 32 bp, Artificial Sequence
  Synthetic polynucleotide
cagcccatttccgcccgtaaacgagcgaaaat

SEQ ID NO: 1102 - DNA, 32 bp, Artificial Sequence
  Synthetic polynucleotide
acatgtaatggggcacgcaattgcctaatccc

SEQ ID NO: 1103 - DNA, 32 bp, Artificial Sequence
  Synthetic polynucleotide
catatatttcacttgcccccaagtaggagatc

SEQ ID NO: 1104 - DNA, 32 bp, Artificial Sequence
  Synthetic polynucleotide
tactaaaagaccaagttgcccatgtatgtgat

SEQ ID NO: 1105 - DNA, 32 bp, Artificial Sequence
  Synthetic polynucleotide
agctctgttgggtgttctcgttcgagcacgca

SEQ ID NO: 1106 - DNA, 32 bp, Artificial Sequence
  Synthetic polynucleotide
ttttttttggaagttcgtgcagcttttttttt

SEQ ID NO: 1107 - DNA, 32 bp, Artificial Sequence
  Synthetic polynucleotide
aatgattacaagaactgctgttcaggcgatac

SEQ ID NO: 1108 - DNA, 32 bp, Artificial Sequence
  Synthetic polynucleotide
gcggccatggagcactatcagctaaggtggcc

SEQ ID NO: 1109 - DNA, 32 bp, Artificial Sequence
  Synthetic polynucleotide
ggtacacctaagccacagtggagcgattgccg

SEQ ID NO: 1110 - DNA, 32 bp, Artificial Sequence
  Synthetic polynucleotide
ggaggcggtacccacatgccgaggaatgcaca

SEQ ID NO: 1111 - DNA, 32 bp, Artificial Sequence
  Synthetic polynucleotide
tggtggtttgactacctaaatggtcgagatgt

SEQ ID NO: 1112 - DNA, 32 bp, Artificial Sequence
  Synthetic polynucleotide
tttttgtcgaggatgtttgctttacacttgag

SEQ ID NO: 1113 - DNA, 32 bp, Artificial Sequence
  Synthetic polynucleotide
tcatacgacaaatctgtctcataaagcctacg

SEQ ID NO: 1114 - DNA, 32 bp, Artificial Sequence
  Synthetic polynucleotide
tttttttttcctatgagttatggatttttttt

SEQ ID NO: 1115 - DNA, 32 bp, Artificial Sequence
  Synthetic polynucleotide
atacacaaccccggtatacttgaacatctgat

SEQ ID NO: 1116 - DNA, 32 bp, Artificial Sequence
  Synthetic polynucleotide
cccccgcaagagtatatagtttgacaaacatt

SEQ ID NO: 1117 - DNA, 32 bp, Artificial Sequence
  Synthetic polynucleotide
gatattcagctcgacctaagcgcgttgtaatg

SEQ ID NO: 1118 - DNA, 32 bp, Artificial Sequence
  Synthetic polynucleotide
gcgtatcggaggtagcaataaggaacgacttt

SEQ ID NO: 1119 - DNA, 32 bp, Artificial Sequence
  Synthetic polynucleotide
cacctttctctggttcaattcatccacccgtt

SEQ ID NO: 1120 - DNA, 32 bp, Artificial Sequence
  Synthetic polynucleotide
ttacttgcacttgggacgtcttaagggtatag

SEQ ID NO: 1121 - DNA, 32 bp, Artificial Sequence
  Synthetic polynucleotide
accgctctttccttttacttacgtgtcctcac

SEQ ID NO: 1122 - DNA, 32 bp, Artificial Sequence
  Synthetic polynucleotide
tttttttttggatatcttccgcgttttttttt

SEQ ID NO: 1123 - DNA, 32 bp, Artificial Sequence
  Synthetic polynucleotide
tcttgcttccgcacgttcaagctgtctgcaac

SEQ ID NO: 1124 - DNA, 32 bp, Artificial Sequence
  Synthetic polynucleotide
gatggccgtaggtttccgcccactctatgaac

SEQ ID NO: 1125 - DNA, 32 bp, Artificial Sequence
  Synthetic polynucleotide
cgaatcgctagtccacactacgctatgtcatg

SEQ ID NO: 1126 - DNA, 32 bp, Artificial Sequence
  Synthetic polynucleotide
gcactgccgctacatgactgtacggcccagcg

SEQ ID NO: 1127 - DNA, 32 bp, Artificial Sequence
  Synthetic polynucleotide
cggcatgcttggctgatgctggtgcatcgccg

SEQ ID NO: 1128 - DNA, 32 bp, Artificial Sequence
  Synthetic polynucleotide
ttaggatcggtgctacatctggtcattgaaag

SEQ ID NO: 1129 - DNA, 32 bp, Artificial Sequence
  Synthetic polynucleotide
gcgttaaacagaaactcgtacgcaggggcata

SEQ ID NO: 1130 - DNA, 32 bp, Artificial Sequence
  Synthetic polynucleotide
ttttttttggtctaaacgaccatgtttttttt

SEQ ID NO: 1131 - DNA, 32 bp, Artificial Sequence
  Synthetic polynucleotide
tgattagcgtcttgcggctattcgtttaaacc

SEQ ID NO: 1132 - DNA, 32 bp, Artificial Sequence
  Synthetic polynucleotide
ggaacttgctgcccagactctcgttccgtgca

SEQ ID NO: 1133 - DNA, 32 bp, Artificial Sequence
  Synthetic polynucleotide
tcgtacagccgccgcagcctgtgatgacatcg

SEQ ID NO: 1134 - DNA, 32 bp, Artificial Sequence
  Synthetic polynucleotide
tgtgggctggactcattcgcaacgatcttagt

SEQ ID NO: 1135 - DNA, 32 bp, Artificial Sequence
  Synthetic polynucleotide
tgtactactgtcaagttgtcgtatcctgcgaa

SEQ ID NO: 1136 - DNA, 32 bp, Artificial Sequence
  Synthetic polynucleotide
tacgctataaagataccgtcgtctaggacgat

SEQ ID NO: 1137 - DNA, 32 bp, Artificial Sequence
  Synthetic polynucleotide
acggggttgtccggtctcacagtgagggtgta

SEQ ID NO: 1138 - DNA, 32 bp, Artificial Sequence
  Synthetic polynucleotide
tttttttttacgattttatttgactttttttt

SEQ ID NO: 1139 - DNA, 32 bp, Artificial Sequence
  Synthetic polynucleotide
ggtaggtttcaccgaagtagtgtcgcagtccg

SEQ ID NO: 1140 - DNA, 32 bp, Artificial Sequence
  Synthetic polynucleotide
tacatacggcttagggaggagaaggccactac

SEQ ID NO: 1141 - DNA, 32 bp, Artificial Sequence
  Synthetic polynucleotide
gtgggagatcgcgtcgatgttgggtgcttatc

SEQ ID NO: 1142 - DNA, 32 bp, Artificial Sequence
  Synthetic polynucleotide
gcctggccttggacgggcgctttccctactct

SEQ ID NO: 1143 - DNA, 32 bp, Artificial Sequence
  Synthetic polynucleotide
aacggcgacttagatcctgaagcgaaaccgtt

SEQ ID NO: 1144 - DNA, 32 bp, Artificial Sequence
  Synthetic polynucleotide
aaagcttccgcgagcacccactgtccacatga

SEQ ID NO: 1145 - DNA, 32 bp, Artificial Sequence
  Synthetic polynucleotide
agaaccggggctagaaatggtttcgcttctcg

SEQ ID NO: 1146 - DNA, 32 bp, Artificial Sequence
  Synthetic polynucleotide
ttttttttactctagcaggtctactttttttt

SEQ ID NO: 1147 - DNA, 32 bp, Artificial Sequence
  Synthetic polynucleotide
tccagaatgatgctatccgtaatctggtgtgt

SEQ ID NO: 1148 - DNA, 32 bp, Artificial Sequence
  Synthetic polynucleotide
gttaatgcagttactgccagtcccttacttgg

SEQ ID NO: 1149 - DNA, 32 bp, Artificial Sequence
  Synthetic polynucleotide
ggtccttcagcacgtacttcgtcacttgtact

SEQ ID NO: 1150 - DNA, 32 bp, Artificial Sequence
  Synthetic polynucleotide
tcttgccagttatacacggggaggccgaacga

SEQ ID NO: 1151 - DNA, 32 bp, Artificial Sequence
  Synthetic polynucleotide
ggtccggggccttgtccaacattttgacggag

SEQ ID NO: 1152 - DNA, 32 bp, Artificial Sequence
  Synthetic polynucleotide
gacttgatagacactacactcgcactacttca

SEQ ID NO: 1153 - DNA, 32 bp, Artificial Sequence
  Synthetic polynucleotide
atctatacatagaatactcccacatatctctt

SEQ ID NO: 1154 - DNA, 32 bp, Artificial Sequence
  Synthetic polynucleotide
ttttttttcgcggaacgcgccagatttttttt

SEQ ID NO: 1155 - DNA, 32 bp, Artificial Sequence
  Synthetic polynucleotide
gaggagcgagcaggtcaccgaagctgctgggt

SEQ ID NO: 1156 - DNA, 32 bp, Artificial Sequence
  Synthetic polynucleotide
gctgaggataattcccctaggacctaaccctt

SEQ ID NO: 1157 - DNA, 32 bp, Artificial Sequence
  Synthetic polynucleotide
tgcggcgctttcaactcccgagtccgggaatt

SEQ ID NO: 1158 - DNA, 32 bp, Artificial Sequence
  Synthetic polynucleotide
ggtccggcaatgggtatcaaggcccgacatcc

SEQ ID NO: 1159 - DNA, 32 bp, Artificial Sequence
  Synthetic polynucleotide
cccatggaattaatacgctctaaattcgttta

SEQ ID NO: 1160 - DNA, 32 bp, Artificial Sequence
  Synthetic polynucleotide
cccgctcgtggtgaatccatgaaaataaaagc

SEQ ID NO: 1161 - DNA, 32 bp, Artificial Sequence
  Synthetic polynucleotide
ggagaatcaacagtgaccctccacgccgggct

SEQ ID NO: 1162 - DNA, 32 bp, Artificial Sequence
  Synthetic polynucleotide
ttttttttgctgccatacgactcttttttttt

SEQ ID NO: 1163 - DNA, 32 bp, Artificial Sequence
  Synthetic polynucleotide
accagttcagacctgtcgcggacacaaaagat

SEQ ID NO: 1164 - DNA, 32 bp, Artificial Sequence
  Synthetic polynucleotide
cacgacgaggtgatctaattcatacgtagttc

SEQ ID NO: 1165 - DNA, 32 bp, Artificial Sequence
  Synthetic polynucleotide
ccccggaacagcattacgctgatcatagtgga

SEQ ID NO: 1166 - DNA, 32 bp, Artificial Sequence
  Synthetic polynucleotide
ccgagattttgatttagaggtggtttgccacc

SEQ ID NO: 1167 - DNA, 32 bp, Artificial Sequence
  Synthetic polynucleotide
ctggtttttaaggaatcaggcaagagccattt

SEQ ID NO: 1168 - DNA, 32 bp, Artificial Sequence
  Synthetic polynucleotide
gccagtaggattgcgctcctcggtgtggaaat

SEQ ID NO: 1169 - DNA, 32 bp, Artificial Sequence
  Synthetic polynucleotide
tctgatatatgaaaacgggagctgcggcgaaa

SEQ ID NO: 1170 - DNA, 32 bp, Artificial Sequence
  Synthetic polynucleotide
ttttttttctgtgctctacgagcttttttttt

SEQ ID NO: 1171 - DNA, 32 bp, Artificial Sequence
  Synthetic polynucleotide
agccgaacctaagccggcaaattaagtaattg

SEQ ID NO: 1172 - DNA, 32 bp, Artificial Sequence
  Synthetic polynucleotide
tctgatggcacaagggtgtcgaaacgtcactt

SEQ ID NO: 1173 - DNA, 32 bp, Artificial Sequence
  Synthetic polynucleotide
cagagcgtcagctccatcgcttttcgggtgtc

SEQ ID NO: 1174 - DNA, 32 bp, Artificial Sequence
  Synthetic polynucleotide
accaatcagtttggaagagataattatccttt

SEQ ID NO: 1175 - DNA, 32 bp, Artificial Sequence
  Synthetic polynucleotide
gattgggttacactaacctcaagccagtgcgg

SEQ ID NO: 1176 - DNA, 32 bp, Artificial Sequence
  Synthetic polynucleotide
tgatcctggctcgtatggcgcggcacccgaga

SEQ ID NO: 1177 - DNA, 32 bp, Artificial Sequence
  Synthetic polynucleotide
gataatacgtcaacttagtaaatgaattagaa

SEQ ID NO: 1178 - DNA, 32 bp, Artificial Sequence
  Synthetic polynucleotide
ttttttttattgacgctaggtcactttttttt

SEQ ID NO: 1179 - DNA, 32 bp, Artificial Sequence
  Synthetic polynucleotide
gtacaaatttctgctatcctgtcgcgatagta

SEQ ID NO: 1180 - DNA, 32 bp, Artificial Sequence
  Synthetic polynucleotide
tatgcccttgttttcgccatatgaacggtatt

SEQ ID NO: 1181 - DNA, 32 bp, Artificial Sequence
  Synthetic polynucleotide
acccatcccgttactgctagagctttaagtat

SEQ ID NO: 1182 - DNA, 32 bp, Artificial Sequence
  Synthetic polynucleotide
gggtgaccgatgaacacaattcccatctcagc

SEQ ID NO: 1183 - DNA, 32 bp, Artificial Sequence
  Synthetic polynucleotide
tcagattcgaaaactgcctagaacactcgccg

SEQ ID NO: 1184 - DNA, 32 bp, Artificial Sequence
  Synthetic polynucleotide
gagaaccggtgcatctaagcctgataatgatc

SEQ ID NO: 1185 - DNA, 32 bp, Artificial Sequence
  Synthetic polynucleotide
aaagtattagtgtctcatcatgagtaggcgga

SEQ ID NO: 1186 - DNA, 32 bp, Artificial Sequence
  Synthetic polynucleotide
ttttttttttatattaactcgctatttttttt

SEQ ID NO: 1187 - DNA, 32 bp, Artificial Sequence
  Synthetic polynucleotide
gtgcgcttattcggatattactggcattaaga

SEQ ID NO: 1188 - DNA, 32 bp, Artificial Sequence
  Synthetic polynucleotide
ctaggtggcggtttacacactaatccgggtat

SEQ ID NO: 1189 - DNA, 32 bp, Artificial Sequence
  Synthetic polynucleotide
acctatataggaggtgcttccatgcgaacccg

SEQ ID NO: 1190 - DNA, 32 bp, Artificial Sequence
  Synthetic polynucleotide
catttcttggtgtcagtataaagcacggccgg

SEQ ID NO: 1191 - DNA, 32 bp, Artificial Sequence
  Synthetic polynucleotide
cgaccattttatcatgcctaggcgctcggcat

SEQ ID NO: 1192 - DNA, 32 bp, Artificial Sequence
  Synthetic polynucleotide
acatggtccatattgttgccatgaaataactt

SEQ ID NO: 1193 - DNA, 32 bp, Artificial Sequence
  Synthetic polynucleotide
atcgctcatactggagttctgaatcaaggcgc

SEQ ID NO: 1194 - DNA, 32 bp, Artificial Sequence
  Synthetic polynucleotide
ttttttttggtcattgccgaattatttttttt

SEQ ID NO: 1195 - DNA, 48 bp, Artificial Sequence
  Synthetic polynucleotide
gcagggtgttcaggctattttataacactcacactgaaaggcgccgtg

SEQ ID NO: 1196 - DNA, 32 bp, Artificial Sequence
  Synthetic polynucleotide
gccgatggccgtcgataccattgtgtcgaatt

SEQ ID NO: 1197 - DNA, 48 bp, Artificial Sequence
  Synthetic polynucleotide
gcggtaactcaattttacagtgccacattgtagatgatatatcgccaa

SEQ ID NO: 1198 - DNA, 32 bp, Artificial Sequence
  Synthetic polynucleotide
ggagtcattaattataccacaaagtattggcc

SEQ ID NO: 1199 - DNA, 48 bp, Artificial Sequence
  Synthetic polynucleotide
gagctcaccctctcctgctgtgccctacaacttattgaagggtaatcc

SEQ ID NO: 1200 - DNA, 32 bp, Artificial Sequence
  Synthetic polynucleotide
aagagcaaccacgtagctctccgcacttacct

SEQ ID NO: 1201 - DNA, 48 bp, Artificial Sequence
  Synthetic polynucleotide
atagaatgagacgtccccatattaaagcgggtaggatggctttttttt

SEQ ID NO: 1202 - DNA, 32 bp, Artificial Sequence
  Synthetic polynucleotide
ttttttttcgcgggctacttaatatttttttt

SEQ ID NO: 1203 - DNA, 48 bp, Artificial Sequence
  Synthetic polynucleotide
gaattatattgacctattttttgtctgtatgagggcacgagcccgacg

SEQ ID NO: 1204 - DNA, 32 bp, Artificial Sequence
  Synthetic polynucleotide
agtctacgcacaggatcgtacctttggctcgt

SEQ ID NO: 1205 - DNA, 48 bp, Artificial Sequence
  Synthetic polynucleotide
gaccacgtttatgtgaatctatgttggtcggtggtcggcctcgtatta

SEQ ID NO: 1206 - DNA, 32 bp, Artificial Sequence
  Synthetic polynucleotide
tgtaccatatcacataaccctaacggactatt

SEQ ID NO: 1207 - DNA, 48 bp, Artificial Sequence
  Synthetic polynucleotide
agttagatatgctgggcgcattcacggacggaccggcgaagtaatggt

SEQ ID NO: 1208 - DNA, 32 bp, Artificial Sequence
  Synthetic polynucleotide
tgggagaaaaaaatcacacaactttaccgagc

SEQ ID NO: 1209 - DNA, 48 bp, Artificial Sequence
  Synthetic polynucleotide
cgtaggagtatccattaaactacacgtcccattataatagtttttttt

SEQ ID NO: 1210 - DNA, 32 bp, Artificial Sequence
  Synthetic polynucleotide
ttttttttctattgagaatggcaatttttttt

SEQ ID NO: 1211 - DNA, 16 bp, Artificial Sequence
  Synthetic polynucleotide
agacaatgttacgccc

SEQ ID NO: 1212 - DNA, 48 bp, Artificial Sequence
  Synthetic polynucleotide
tagcgccttaacagcataagaacataggtggtagggttcagttcccct

SEQ ID NO: 1213 - DNA, 48 bp, Artificial Sequence
  Synthetic polynucleotide
ggctccaagatatcgcttacgagtataccctacgtttattccccgctc

SEQ ID NO: 1214 - DNA, 48 bp, Artificial Sequence
  Synthetic polynucleotide
cgtagtgggcactaaggatgcgttggttcgtgagtgtttttatcaaag

SEQ ID NO: 1215 - DNA, 32 bp, Artificial Sequence
  Synthetic polynucleotide
ttttttttgaacgatactgaaggatttttttt

SEQ ID NO: 1216 - DNA, 16 bp, Artificial Sequence
  Synthetic polynucleotide
aggtcatctaggcaag

SEQ ID NO: 1217 - DNA, 48 bp, Artificial Sequence
  Synthetic polynucleotide
ggtcagacccaccttacgaaggtcaggctgcgggtagaaggaactctg

SEQ ID NO: 1218 - DNA, 48 bp, Artificial Sequence
  Synthetic polynucleotide
gctgatgcggtattttttgtcgttatgtgaagaatgttctgaggttag

SEQ ID NO: 1219 - DNA, 48 bp, Artificial Sequence
  Synthetic polynucleotide
gcatgagaacctaatgcgcctccgacctgccataacacttggtctcga

SEQ ID NO: 1220 - DNA, 32 bp, Artificial Sequence
  Synthetic polynucleotide
ttttttttcctgcttcctagtaactttttttt

SEQ ID NO: 1221 - DNA, 48 bp, Artificial Sequence
  Synthetic polynucleotide
gtaagatattttttttttttttttctatagggcacattagagtgttgc

SEQ ID NO: 1222 - DNA, 32 bp, Artificial Sequence
  Synthetic polynucleotide
acatgatcgatgggaagctaggagagctagct

SEQ ID NO: 1223 - DNA, 48 bp, Artificial Sequence
  Synthetic polynucleotide
tcacagtggttgctatgcagtaagtctttcaaaggatctcagaggttc

SEQ ID NO: 1224 - DNA, 32 bp, Artificial Sequence
  Synthetic polynucleotide
attctgacctatatacaaataaactaacgtga

SEQ ID NO: 1225 - DNA, 48 bp, Artificial Sequence
  Synthetic polynucleotide
ctagtatacgctccgagcgcgcagaacgacaaacgaatcctcgtggaa

SEQ ID NO: 1226 - DNA, 32 bp, Artificial Sequence
  Synthetic polynucleotide
cccatgcagaaagataaagtccgtgtcggtag

SEQ ID NO: 1227 - DNA, 48 bp, Artificial Sequence
  Synthetic polynucleotide
gcgatggtgatgggaaataggtaactgggtttgatatttcaaggacac

SEQ ID NO: 1228 - DNA, 32 bp, Artificial Sequence
  Synthetic polynucleotide
cgccctgacgtagaacaagcagagcattttga

SEQ ID NO: 1229 - DNA, 48 bp, Artificial Sequence
  Synthetic polynucleotide
tcattagggtccaccgcggcgatttttttttttttttttttaatttgt

SEQ ID NO: 1230 - DNA, 48 bp, Artificial Sequence
  Synthetic polynucleotide
tgcctgccggtgtgagcgtgggtcttagagttgactgcctcattaata

SEQ ID NO: 1231 - DNA, 48 bp, Artificial Sequence
  Synthetic polynucleotide
tccgcataaggattaacagtgtcatcggtacagccagggttatccggt

SEQ ID NO: 1232 - DNA, 48 bp, Artificial Sequence
  Synthetic polynucleotide
cgacatcgaccgttcacgtaatgttccactcgcaatccattacggaca

SEQ ID NO: 1233 - DNA, 16 bp, Artificial Sequence
  Synthetic polynucleotide
ttttttttgtatcatc

SEQ ID NO: 1234 - DNA, 32 bp, Artificial Sequence
  Synthetic polynucleotide
cgagtgtatttttttttttttttttcgacacg

SEQ ID NO: 1235 - DNA, 48 bp, Artificial Sequence
  Synthetic polynucleotide
gtgatagatcctcgcacccattaaaagccaagcggtcacttcccagta

SEQ ID NO: 1236 - DNA, 32 bp, Artificial Sequence
  Synthetic polynucleotide
cttatctatagtgctagtagtttcctccgaaa

SEQ ID NO: 1237 - DNA, 48 bp, Artificial Sequence
  Synthetic polynucleotide
cccttatcagcagtaatgtgagggagtaccagtgccaaaatgaacttc

SEQ ID NO: 1238 - DNA, 32 bp, Artificial Sequence
  Synthetic polynucleotide
aatgtaaatgtctcccctcccatcactgttac

SEQ ID NO: 1239 - DNA, 48 bp, Artificial Sequence
  Synthetic polynucleotide
ccgcgctggaatcataacccgaaaaagggccaggagtgtttacatctc

SEQ ID NO: 1240 - DNA, 32 bp, Artificial Sequence
  Synthetic polynucleotide
gctcgtcctcaccataatccaccaaaggtaat

SEQ ID NO: 1241 - DNA, 32 bp, Artificial Sequence
  Synthetic polynucleotide
gtgaaactcaatgatatgacggatgtgctctt

SEQ ID NO: 1242 - DNA, 16 bp, Artificial Sequence
  Synthetic polynucleotide
gagcggtgtttttttt

SEQ ID NO: 1243 - DNA, 48 bp, Artificial Sequence
  Synthetic polynucleotide
ttaagagcctcgcttcactgaggcgagttaacttatgttctaacctgc

SEQ ID NO: 1244 - DNA, 48 bp, Artificial Sequence
  Synthetic polynucleotide
gcgtatgctgaaatggaaccctcctacgttttgtaatgcgaaaccagg

SEQ ID NO: 1245 - DNA, 48 bp, Artificial Sequence
  Synthetic polynucleotide
agcctattcatcaagggaaagatcataacgttgggatttgttccgcct

SEQ ID NO: 1246 - DNA, 32 bp, Artificial Sequence
  Synthetic polynucleotide
agctcattctcggtccaattcgagcatgtccc

SEQ ID NO: 1247 - DNA, 48 bp, Artificial Sequence
  Synthetic polynucleotide
cgacctctttttttttttttttttagatcccaatgttaggagctaaca

SEQ ID NO: 1248 - DNA, 32 bp, Artificial Sequence
  Synthetic polynucleotide
gacccgacactcgcctgtttccgtgcgttctt

SEQ ID NO: 1249 - DNA, 48 bp, Artificial Sequence
  Synthetic polynucleotide
gccagacttttacggcggtaggtgtaagaccttcagcggcaacccgtt

SEQ ID NO: 1250 - DNA, 32 bp, Artificial Sequence
  Synthetic polynucleotide
caatccctagccgttcaagaatggtctacatc

SEQ ID NO: 1251 - DNA, 48 bp, Artificial Sequence
  Synthetic polynucleotide
gtaatgaaggatagatttctagccactggcacgctggtaatctgggct

SEQ ID NO: 1252 - DNA, 32 bp, Artificial Sequence
  Synthetic polynucleotide
attaagctgtggaatgttgttgaacatactcc

SEQ ID NO: 1253 - DNA, 48 bp, Artificial Sequence
  Synthetic polynucleotide
gtcctatcccttactagcggtacacaccaagaaccaatgtaagcagat

SEQ ID NO: 1254 - DNA, 32 bp, Artificial Sequence
  Synthetic polynucleotide
ggatctaccggcatgcctcctgaccctttaca

SEQ ID NO: 1255 - DNA, 48 bp, Artificial Sequence
  Synthetic polynucleotide
ctccgaaatggaagtgaaactactttttttttttttttttttaggtga

SEQ ID NO: 1256 - DNA, 48 bp, Artificial Sequence
  Synthetic polynucleotide
taatctcatttttaactgttatatgatatttggggttatacaccgtgt

SEQ ID NO: 1257 - DNA, 48 bp, Artificial Sequence
  Synthetic polynucleotide
agcttcgcaatcttctgctgcctctaggggggtttgtccatgcctgta

SEQ ID NO: 1258 - DNA, 48 bp, Artificial Sequence
  Synthetic polynucleotide
caatagtcgtgaccgagcgctagtcacgcgaagggccgacaatcggcg

SEQ ID NO: 1259 - DNA, 16 bp, Artificial Sequence
  Synthetic polynucleotide
ttttttttcacctgta

SEQ ID NO: 1260 - DNA, 32 bp, Artificial Sequence
  Synthetic polynucleotide
tactggaatttttttttttttttttgttaagc

SEQ ID NO: 1261 - DNA, 48 bp, Artificial Sequence
  Synthetic polynucleotide
gtaaataacggcagttgtgaaaggagtggcttcctaggtgaacgtggg

SEQ ID NO: 1262 - DNA, 32 bp, Artificial Sequence
  Synthetic polynucleotide
aaactggtttggtatatcctgatacgcgagca

SEQ ID NO: 1263 - DNA, 48 bp, Artificial Sequence
  Synthetic polynucleotide
ggggcgtcgaaggctgtctttgtgtgggtattgaaatcccgtcaccga

SEQ ID NO: 1264 - DNA, 32 bp, Artificial Sequence
  Synthetic polynucleotide
ggttttcttagactttgactcagacggatatg

SEQ ID NO: 1265 - DNA, 48 bp, Artificial Sequence
  Synthetic polynucleotide
ctgtagacggtcggcgtcccttctcccggatttcaggtcggcacgata

SEQ ID NO: 1266 - DNA, 32 bp, Artificial Sequence
  Synthetic polynucleotide
tgatatgtcgttccttaaggccaaacgcgttt

SEQ ID NO: 1267 - DNA, 32 bp, Artificial Sequence
  Synthetic polynucleotide
taatgccgacatggaacgttatagtttgccaa

SEQ ID NO: 1268 - DNA, 16 bp, Artificial Sequence
  Synthetic polynucleotide
gtttaccctttttttt

SEQ ID NO: 1269 - DNA, 48 bp, Artificial Sequence
  Synthetic polynucleotide
gctccccgcacgggttttgtacccacgcggttcacacgaattcggggg

SEQ ID NO: 1270 - DNA, 48 bp, Artificial Sequence
  Synthetic polynucleotide
cgaccgctctagatctgtgtggcacctgttagcgcggtgacatgacgg

SEQ ID NO: 1271 - DNA, 48 bp, Artificial Sequence
  Synthetic polynucleotide
ccatcgctgataaagggctcttaacaacactatcaactcgtacacact

SEQ ID NO: 1272 - DNA, 32 bp, Artificial Sequence
  Synthetic polynucleotide
cgtcactagtcgcccgaatcaagtagggcgaa

SEQ ID NO: 1273 - DNA, 48 bp, Artificial Sequence
  Synthetic polynucleotide
taccgcaattttttttttttttttatgccccgaacaacgtgtctcatt

SEQ ID NO: 1274 - DNA, 32 bp, Artificial Sequence
  Synthetic polynucleotide
cgacataactagccgtgtgataggctctcagc

SEQ ID NO: 1275 - DNA, 48 bp, Artificial Sequence
  Synthetic polynucleotide
aactgtgtctgaggccttggccctcctcgccttcggacgttacacgcg

SEQ ID NO: 1276 - DNA, 32 bp, Artificial Sequence
  Synthetic polynucleotide
aacttaaagatcgacgacgagattgtattcgt

SEQ ID NO: 1277 - DNA, 48 bp, Artificial Sequence
  Synthetic polynucleotide
caggagtaacccgaccctccctgtcctgttggattttcggattttgtt

SEQ ID NO: 1278 - DNA, 32 bp, Artificial Sequence
  Synthetic polynucleotide
agaagtttaactgcaacagagcactacacgcc

SEQ ID NO: 1279 - DNA, 48 bp, Artificial Sequence
  Synthetic polynucleotide
gtcttgacatcaaacaaaggctgtttagagtaaagcggattcgagcgt

SEQ ID NO: 1280 - DNA, 32 bp, Artificial Sequence
  Synthetic polynucleotide
cgcaggggatgggcagcggttaagggcaactg

SEQ ID NO: 1281 - DNA, 48 bp, Artificial Sequence
  Synthetic polynucleotide
ttgtaacttaatccatcttaatgattttttttttttttttcccgcttg

SEQ ID NO: 1282 - DNA, 48 bp, Artificial Sequence
  Synthetic polynucleotide
agtaaggacattacactcagtgattccagagcgttaacacagcggagt

SEQ ID NO: 1283 - DNA, 48 bp, Artificial Sequence
  Synthetic polynucleotide
tccttgttccgacctaaaggagagggcgactgtagacaggtattgccg

SEQ ID NO: 1284 - DNA, 48 bp, Artificial Sequence
  Synthetic polynucleotide
acgtaggcactcaactcggtgaaaccaagattgttatagaagaataca

SEQ ID NO: 1285 - DNA, 16 bp, Artificial Sequence
  Synthetic polynucleotide
ttttttttcattccaa

SEQ ID NO: 1286 - DNA, 32 bp, Artificial Sequence
  Synthetic polynucleotide
tatcgagatttttttttttttttttccacaca

SEQ ID NO: 1287 - DNA, 48 bp, Artificial Sequence
  Synthetic polynucleotide
agcaaagatccttggcatagttagtgactaggtttagtttcgcgttag

SEQ ID NO: 1288 - DNA, 32 bp, Artificial Sequence
  Synthetic polynucleotide
atgttaacttatgcattgcggtacaaccgata

SEQ ID NO: 1289 - DNA, 48 bp, Artificial Sequence
  Synthetic polynucleotide
acctggtgtaaagcgagtaacgacgaccaactctatgaaaggcgcact

SEQ ID NO: 1290 - DNA, 32 bp, Artificial Sequence
  Synthetic polynucleotide
taattctgggttaagtttgacatctaaattaa

SEQ ID NO: 1291 - DNA, 48 bp, Artificial Sequence
  Synthetic polynucleotide
ccacctgccagcgcaaaaggcctctaggcagggtactgcttccatact

SEQ ID NO: 1292 - DNA, 32 bp, Artificial Sequence
  Synthetic polynucleotide
agacgggagaaggacttgcaccaactaaagac

SEQ ID NO: 1293 - DNA, 32 bp, Artificial Sequence
  Synthetic polynucleotide
ggggttgagagggctgtgcaaagagaccttcc

SEQ ID NO: 1294 - DNA, 16 bp, Artificial Sequence
  Synthetic polynucleotide
tcacattttttttttt

SEQ ID NO: 1295 - DNA, 48 bp, Artificial Sequence
  Synthetic polynucleotide
ttattgggggtgaagactagaacgttgccaccgtgtgaccatagcgct

SEQ ID NO: 1296 - DNA, 48 bp, Artificial Sequence
  Synthetic polynucleotide
caagggatatcggctccttcggattctctggccttacactttcgggag

SEQ ID NO: 1297 - DNA, 48 bp, Artificial Sequence
  Synthetic polynucleotide
aaagtaatatgggttgcactaaactatagcaagatcacaaatatggca

SEQ ID NO: 1298 - DNA, 32 bp, Artificial Sequence
  Synthetic polynucleotide
acaaagtctgggagggcctcaacatcttgaat

SEQ ID NO: 1299 - DNA, 48 bp, Artificial Sequence
  Synthetic polynucleotide
gatcctgattttttttttttttttgagattactgatatggtccaaaat

SEQ ID NO: 1300 - DNA, 32 bp, Artificial Sequence
  Synthetic polynucleotide
gtgcaacgggaaacactgggcccggggtttgt

SEQ ID NO: 1301 - DNA, 48 bp, Artificial Sequence
  Synthetic polynucleotide
tgtttactggtacaattcttacacgggtaggagcgcagtttccttgat

SEQ ID NO: 1302 - DNA, 32 bp, Artificial Sequence
  Synthetic polynucleotide
aggataaggcagtgactgtaatattgggtact

SEQ ID NO: 1303 - DNA, 48 bp, Artificial Sequence
  Synthetic polynucleotide
ataaccatcctggtgaaacgggatgggaagggggcgtaggggccgcac

SEQ ID NO: 1304 - DNA, 32 bp, Artificial Sequence
  Synthetic polynucleotide
tggaccacgcgctgtgacaggcttcgtcgccg

SEQ ID NO: 1305 - DNA, 48 bp, Artificial Sequence
  Synthetic polynucleotide
aaatgtagccatgaatttacagcgacgcctcgttctgtcaatgtctac

SEQ ID NO: 1306 - DNA, 32 bp, Artificial Sequence
  Synthetic polynucleotide
atccgacctggggggattatgaaaggcgggtg

SEQ ID NO: 1307 - DNA, 48 bp, Artificial Sequence
  Synthetic polynucleotide
aaaaccagcccgacaactcaatcatttttttttttttttttgctctcc

SEQ ID NO: 1308 - DNA, 48 bp, Artificial Sequence
  Synthetic polynucleotide
ttacgaaaagcaatcgtcgtaatgttcaatataaatggttgtatattg

SEQ ID NO: 1309 - DNA, 48 bp, Artificial Sequence
  Synthetic polynucleotide
gagtgtgtatcggtgtggggtacggtgagcccacagttgtgcaaatga

SEQ ID NO: 1310 - DNA, 48 bp, Artificial Sequence
  Synthetic polynucleotide
tccccagcctccagggccttcgtctgtgagggttattggagatgtcgg

SEQ ID NO: 1311 - DNA, 16 bp, Artificial Sequence
  Synthetic polynucleotide
ttttttttacttcttt

SEQ ID NO: 1312 - DNA, 32 bp, Artificial Sequence
  Synthetic polynucleotide
gcctggaattttttttttttttttggaccatg

SEQ ID NO: 1313 - DNA, 48 bp, Artificial Sequence
  Synthetic polynucleotide
ctcgcagtttcatactggtctctaaagccgtgagaggaccgtatgttt

SEQ ID NO: 1314 - DNA, 32 bp, Artificial Sequence
  Synthetic polynucleotide
tggatacttttcggcctcagcgggtcactctt

SEQ ID NO: 1315 - DNA, 48 bp, Artificial Sequence
  Synthetic polynucleotide
tgccgcaattctttcaacgggggctcacacttcctacatgaaataaag

SEQ ID NO: 1316 - DNA, 32 bp, Artificial Sequence
  Synthetic polynucleotide
gtacccgtcccaggaagaccacccagactcga

SEQ ID NO: 1317 - DNA, 48 bp, Artificial Sequence
  Synthetic polynucleotide
ctagcacggagtttcgagcttgcgctagctaggttttacggtagcaaa

SEQ ID NO: 1318 - DNA, 32 bp, Artificial Sequence
  Synthetic polynucleotide
agagaggtaggatcacagggttcacccatgcc

SEQ ID NO: 1319 - DNA, 32 bp, Artificial Sequence
  Synthetic polynucleotide
gccatatcaatgtctagcatccggttcaggaa

SEQ ID NO: 1320 - DNA, 16 bp, Artificial Sequence
  Synthetic polynucleotide
cggagtaatttttttt

SEQ ID NO: 1321 - DNA, 48 bp, Artificial Sequence
  Synthetic polynucleotide
gctccttcgtcctcaggtcagtcgatgaagccatgaatgtacccgtca

SEQ ID NO: 1322 - DNA, 48 bp, Artificial Sequence
  Synthetic polynucleotide
cagttttctcatcgacggataattcctattgctgtatggctactaata

SEQ ID NO: 1323 - DNA, 48 bp, Artificial Sequence
  Synthetic polynucleotide
ttccccggggaatgctagttacctgcttcgggtaaaccaaaagggtca

SEQ ID NO: 1324 - DNA, 32 bp, Artificial Sequence
  Synthetic polynucleotide
cggtacagtaaacgggtaataatagcataacc

SEQ ID NO: 1325 - DNA, 48 bp, Artificial Sequence
  Synthetic polynucleotide
ttagtccgtttttttttttttttttattagtggctaacttacctgaaa

SEQ ID NO: 1326 - DNA, 32 bp, Artificial Sequence
  Synthetic polynucleotide
gaagatttagtatccaaagtgtcaactagttc

SEQ ID NO: 1327 - DNA, 48 bp, Artificial Sequence
  Synthetic polynucleotide
ggcaagagtcaggaattaagcgtctcctcctccctgattgatatagag

SEQ ID NO: 1328 - DNA, 32 bp, Artificial Sequence
  Synthetic polynucleotide
gtaattaggatgtaaagggttgtggcgggggt

SEQ ID NO: 1329 - DNA, 48 bp, Artificial Sequence
  Synthetic polynucleotide
taacgccgcggtagctagggtaggcgtagaggaaccagcctacgctgg

SEQ ID NO: 1330 - DNA, 32 bp, Artificial Sequence
  Synthetic polynucleotide
tgtaggactagacgtttataccttaatgagat

SEQ ID NO: 1331 - DNA, 48 bp, Artificial Sequence
  Synthetic polynucleotide
ccagtggtttgaatcatggtgttagtttgttaagccgttaggtatgcg

SEQ ID NO: 1332 - DNA, 32 bp, Artificial Sequence
  Synthetic polynucleotide
atgactatggaccgtttagctctcaagctata

SEQ ID NO: 1333 - DNA, 48 bp, Artificial Sequence
  Synthetic polynucleotide
ctggtaataacttcggagtcgaacttttttttttttttttccgtctat

SEQ ID NO: 1334 - DNA, 48 bp, Artificial Sequence
  Synthetic polynucleotide
gcatagtcgcataattactacgtgattcgatgctcgagtcctcaggtt

SEQ ID NO: 1335 - DNA, 48 bp, Artificial Sequence
  Synthetic polynucleotide
gcaaatacttatcagccccgttggtccggtgccagtcatcatgtacga

SEQ ID NO: 1336 - DNA, 48 bp, Artificial Sequence
  Synthetic polynucleotide
tggggatatcaacacaagagtctggagatgatgtagggtaccgctggg

SEQ ID NO: 1337 - DNA, 16 bp, Artificial Sequence
  Synthetic polynucleotide
ttttttttgttgccct

SEQ ID NO: 1338 - DNA, 32 bp, Artificial Sequence
  Synthetic polynucleotide
cgaccgattttttttttttttttttagggtga

SEQ ID NO: 1339 - DNA, 48 bp, Artificial Sequence
  Synthetic polynucleotide
cgtattagacctcttagcacaataagcagaatggtataaagcaataaa

SEQ ID NO: 1340 - DNA, 32 bp, Artificial Sequence
  Synthetic polynucleotide
gaaactgcactcctactgcccgcctcagagtt

SEQ ID NO: 1341 - DNA, 48 bp, Artificial Sequence
  Synthetic polynucleotide
cccaccactgttgaacgttgctaaggcacttgaacttcgcgacatatt

SEQ ID NO: 1342 - DNA, 32 bp, Artificial Sequence
  Synthetic polynucleotide
caaatgagcagcgagcgttttacggtgaacgg

SEQ ID NO: 1343 - DNA, 48 bp, Artificial Sequence
  Synthetic polynucleotide
tgggcattgactacctacatcaggtttgcgtgcctaaccatgatcagc

SEQ ID NO: 1344 - DNA, 32 bp, Artificial Sequence
  Synthetic polynucleotide
cctgctaaaaaatatgcagggttatgacccta

SEQ ID NO: 1345 - DNA, 32 bp, Artificial Sequence
  Synthetic polynucleotide
ctacatctccttcgcgcccgacaactttgaaa

SEQ ID NO: 1346 - DNA, 16 bp, Artificial Sequence
  Synthetic polynucleotide
cctgtgcttttttttt

SEQ ID NO: 1347 - DNA, 48 bp, Artificial Sequence
  Synthetic polynucleotide
gctgcctgttgtcccctcgtcatagggtcccaagaacggccgtctcac

SEQ ID NO: 1348 - DNA, 48 bp, Artificial Sequence
  Synthetic polynucleotide
tccaatacgggatctcccatttaatggcaaattgtatctcacgggccc

SEQ ID NO: 1349 - DNA, 48 bp, Artificial Sequence
  Synthetic polynucleotide
agttgaccactatcaataagggtattgtcctacggcggctcaacccgt

SEQ ID NO: 1350 - DNA, 32 bp, Artificial Sequence
  Synthetic polynucleotide
gcaggttaagcatgtcttgcaacttaagattc

SEQ ID NO: 1351 - DNA, 48 bp, Artificial Sequence
  Synthetic polynucleotide
agttagcattttttttttttttttttacgcgggtaccctggaccgcta

SEQ ID NO: 1352 - DNA, 32 bp, Artificial Sequence
  Synthetic polynucleotide
acctggtccgtcatactaaaaggtagaagtaa

SEQ ID NO: 1353 - DNA, 48 bp, Artificial Sequence
  Synthetic polynucleotide
cagtccgacctaggagcggtctggctgtgaggggtgtaggtacgccca

SEQ ID NO: 1354 - DNA, 32 bp, Artificial Sequence
  Synthetic polynucleotide
taaactacttttccaccgtccagcgcatctgt

SEQ ID NO: 1355 - DNA, 48 bp, Artificial Sequence
  Synthetic polynucleotide
gatccacgtcagatttatacgtgcctcgcgcaacgctcagccggtctg

SEQ ID NO: 1356 - DNA, 32 bp, Artificial Sequence
  Synthetic polynucleotide
gctagcatctcaagacctgggaattaggtaag

SEQ ID NO: 1357 - DNA, 48 bp, Artificial Sequence
  Synthetic polynucleotide
taagtagtcgtgtggctgcaagccctcacctgaaccgcgcctaagtct

SEQ ID NO: 1358 - DNA, 32 bp, Artificial Sequence
  Synthetic polynucleotide
ttagaatcaccttaggttttcgcaggcacatc

SEQ ID NO: 1359 - DNA, 48 bp, Artificial Sequence
  Synthetic polynucleotide
gagcctacccgtctatcggacacattttttttttttttttcggcttgc

SEQ ID NO: 1360 - DNA, 48 bp, Artificial Sequence
  Synthetic polynucleotide
tgcgaccaagttttatctgtcatatgccatctgattgggagagtccag

SEQ ID NO: 1361 - DNA, 48 bp, Artificial Sequence
  Synthetic polynucleotide
cccgacctgtgctcacgcacgagaaggcttccccatgggtactgctgt

SEQ ID NO: 1362 - DNA, 48 bp, Artificial Sequence
  Synthetic polynucleotide
gagggtaacacgttgggatgatctgtggtgcgcacaatttgctggaag

SEQ ID NO: 1363 - DNA, 16 bp, Artificial Sequence
  Synthetic polynucleotide
ttttttttcgtaacga

SEQ ID NO: 1364 - DNA, 32 bp, Artificial Sequence
  Synthetic polynucleotide
cgtcaatgttttttttttttttttttaaaaca

SEQ ID NO: 1365 - DNA, 48 bp, Artificial Sequence
  Synthetic polynucleotide
acaaccgatgtttgcttctaacccggctacgagtggtctggacagtat

SEQ ID NO: 1366 - DNA, 32 bp, Artificial Sequence
  Synthetic polynucleotide
gaaggaaccgggagcctcgggggagcagtccc

SEQ ID NO: 1367 - DNA, 48 bp, Artificial Sequence
  Synthetic polynucleotide
ggtcttccctgcaagaatgcatgattttcctacatggaatgtacagtt

SEQ ID NO: 1368 - DNA, 32 bp, Artificial Sequence
  Synthetic polynucleotide
cctgacatcacagtcaatcggtaggtgggcct

SEQ ID NO: 1369 - DNA, 48 bp, Artificial Sequence
  Synthetic polynucleotide
tgaggttatgtccttgtccgcgatttcgtccggtgctctacatttggg

SEQ ID NO: 1370 - DNA, 32 bp, Artificial Sequence
  Synthetic polynucleotide
gcagtggatgcttgctccttgctccataccta

SEQ ID NO: 1371 - DNA, 32 bp, Artificial Sequence
  Synthetic polynucleotide
ccctggcgccttcatcacggacttcatcaagt

SEQ ID NO: 1372 - DNA, 16 bp, Artificial Sequence
  Synthetic polynucleotide
aatatgcatttttttt

SEQ ID NO: 1373 - DNA, 48 bp, Artificial Sequence
  Synthetic polynucleotide
cgccccaactgctcctagttaagcatgcttggaccaatcgtacacaaa

SEQ ID NO: 1374 - DNA, 48 bp, Artificial Sequence
  Synthetic polynucleotide
taagaggcatggtatagcataatcttcgtggacccagtcgcaaggcag

SEQ ID NO: 1375 - DNA, 48 bp, Artificial Sequence
  Synthetic polynucleotide
ttgtcactcatcggctaacgatatcttttggagtccggtgtacgagat

SEQ ID NO: 1376 - DNA, 32 bp, Artificial Sequence
  Synthetic polynucleotide
cctgaagaatctctgtataagggcgattcttc

SEQ ID NO: 1377 - DNA, 48 bp, Artificial Sequence
  Synthetic polynucleotide
cttactgcgcaacactctaatgtgccctatagcaccgctcgttaactc

SEQ ID NO: 1378 - DNA, 48 bp, Artificial Sequence
  Synthetic polynucleotide
ctgcgcgcgaacctctgagatcctttgaaagagctcttaaaaaacgta

SEQ ID NO: 1379 - DNA, 48 bp, Artificial Sequence
  Synthetic polynucleotide
ttacctatttccacgaggattcgtttgtcgttgcatacgcaacgttat

SEQ ID NO: 1380 - DNA, 48 bp, Artificial Sequence
  Synthetic polynucleotide
ttttttttgtgtccttgaaatatcaaacccagaataggctggaccgag

SEQ ID NO: 1381 - DNA, 16 bp, Artificial Sequence
  Synthetic polynucleotide
tatcttacttcccatc

SEQ ID NO: 1382 - DNA, 48 bp, Artificial Sequence
  Synthetic polynucleotide
aggcagtcagctagctctcctagcacaaattatacactcgtgcgagga

SEQ ID NO: 1383 - DNA, 48 bp, Artificial Sequence
  Synthetic polynucleotide
accctggctcacgttagtttattttattaatgtagataagttactgct

SEQ ID NO: 1384 - DNA, 48 bp, Artificial Sequence
  Synthetic polynucleotide
atggattgctaccgacacggacttaccggatatttacatttatgattc

SEQ ID NO: 1385 - DNA, 48 bp, Artificial Sequence
  Synthetic polynucleotide
tttttttttcaaaatgctctgctttgtccgtaggacgagctatcattg

SEQ ID NO: 1386 - DNA, 16 bp, Artificial Sequence
  Synthetic polynucleotide
aatcgccgcggtggac

SEQ ID NO: 1387 - DNA, 32 bp, Artificial Sequence
  Synthetic polynucleotide
ttaatggggatgatacagtagtttcacttcca

SEQ ID NO: 1388 - DNA, 48 bp, Artificial Sequence
  Synthetic polynucleotide
agtgaccgcttggcttcctaatgaaactctaagacccacgctcacacc

SEQ ID NO: 1389 - DNA, 32 bp, Artificial Sequence
  Synthetic polynucleotide
ccctcacatactgggaatataacagttaaaaa

SEQ ID NO: 1390 - DNA, 48 bp, Artificial Sequence
  Synthetic polynucleotide
ttttggcactggtactggcaggcatgtaccgatgacactgttaatcct

SEQ ID NO: 1391 - DNA, 32 bp, Artificial Sequence
  Synthetic polynucleotide
tttcgggtgaagttcagaggcagcagaagatt

SEQ ID NO: 1392 - DNA, 48 bp, Artificial Sequence
  Synthetic polynucleotide
aacactcctggccctttatgcggacgagtggaacattacgtgaacggt

SEQ ID NO: 1393 - DNA, 32 bp, Artificial Sequence
  Synthetic polynucleotide
atccgtcagagatgtaactagcgctcggtcac

SEQ ID NO: 1394 - DNA, 32 bp, Artificial Sequence
  Synthetic polynucleotide
ttttttttaagagcaccgatgtcgtttttttt

SEQ ID NO: 1395 - DNA, 32 bp, Artificial Sequence
  Synthetic polynucleotide
gaacataacgtgtcgaagaggtcgaggcgagt

SEQ ID NO: 1396 - DNA, 48 bp, Artificial Sequence
  Synthetic polynucleotide
gaaactacgcaggttagatcatgtatagcaaccactgtgagtatatag

SEQ ID NO: 1397 - DNA, 32 bp, Artificial Sequence
  Synthetic polynucleotide
cgcattactttcggagagtctggcgaacggct

SEQ ID NO: 1398 - DNA, 48 bp, Artificial Sequence
  Synthetic polynucleotide
gatgggagcctggtttgtcagaattcggagcgtatactagtatctttc

SEQ ID NO: 1399 - DNA, 32 bp, Artificial Sequence
  Synthetic polynucleotide
caaatcccgtaacagtttcattaccattccac

SEQ ID NO: 1400 - DNA, 48 bp, Artificial Sequence
  Synthetic polynucleotide
tggtggataggcggaatgcatgggttcccatcaccatcgcgttctacg

SEQ ID NO: 1401 - DNA, 32 bp, Artificial Sequence
  Synthetic polynucleotide
ctcgaattattaccttgataggacgcatgccg

SEQ ID NO: 1402 - DNA, 32 bp, Artificial Sequence
  Synthetic polynucleotide
ttttttttgggacatgtcagggcgtttttttt

SEQ ID NO: 1403 - DNA, 32 bp, Artificial Sequence
  Synthetic polynucleotide
cctaacattgggatctgggtaaacaaccgcgt

SEQ ID NO: 1404 - DNA, 32 bp, Artificial Sequence
  Synthetic polynucleotide
cacctacctgttagctgcctcagtgaagcgag

SEQ ID NO: 1405 - DNA, 32 bp, Artificial Sequence
  Synthetic polynucleotide
gccgctgaaggtcttacggggagcctaacagg

SEQ ID NO: 1406 - DNA, 32 bp, Artificial Sequence
  Synthetic polynucleotide
ggctagaaaacgggttggagggttccatttca

SEQ ID NO: 1407 - DNA, 32 bp, Artificial Sequence
  Synthetic polynucleotide
ttaccagcgtgccagtagcggtcgtagtgttg

SEQ ID NO: 1408 - DNA, 32 bp, Artificial Sequence
  Synthetic polynucleotide
tgtaccgcagcccagagatctttcccttgatg

SEQ ID NO: 1409 - DNA, 32 bp, Artificial Sequence
  Synthetic polynucleotide
acattggttcttggtgagcgatggcgggcgac

SEQ ID NO: 1410 - DNA, 32 bp, Artificial Sequence
  Synthetic polynucleotide
ttttttttatctgcttaatgagcttttttttt

SEQ ID NO: 1411 - DNA, 32 bp, Artificial Sequence
  Synthetic polynucleotide
acggaaactcacctaattccagtaaactgccg

SEQ ID NO: 1412 - DNA, 32 bp, Artificial Sequence
  Synthetic polynucleotide
tataacccaagaacgctctatcactagcacta

SEQ ID NO: 1413 - DNA, 32 bp, Artificial Sequence
  Synthetic polynucleotide
ccattcttacacggtgaccagtttcagccttc

SEQ ID NO: 1414 - DNA, 32 bp, Artificial Sequence
  Synthetic polynucleotide
tggacaaagatgtagagataaggggggagaca

SEQ ID NO: 1415 - DNA, 32 bp, Artificial Sequence
  Synthetic polynucleotide
ttcaacaatacaggcaagaaaacccgccgacc

SEQ ID NO: 1416 - DNA, 32 bp, Artificial Sequence
  Synthetic polynucleotide
gtcggcccggagtatgcagcgcggtatggtga

SEQ ID NO: 1417 - DNA, 32 bp, Artificial Sequence
  Synthetic polynucleotide
gtcaggagcgccgattacatatcattccatgt

SEQ ID NO: 1418 - DNA, 32 bp, Artificial Sequence
  Synthetic polynucleotide
tttttttttgtaaaggagtttcactttttttt

SEQ ID NO: 1419 - DNA, 32 bp, Artificial Sequence
  Synthetic polynucleotide
cctttcactacaggtgtcattaagatggatta

SEQ ID NO: 1420 - DNA, 32 bp, Artificial Sequence
  Synthetic polynucleotide
cacctaggaagccacttttcggagcaaatatc

SEQ ID NO: 1421 - DNA, 32 bp, Artificial Sequence
  Synthetic polynucleotide
cacaaagacccacgttatcactgagtgtaatg

SEQ ID NO: 1422 - DNA, 32 bp, Artificial Sequence
  Synthetic polynucleotide
gggatttcaatacccatgagattaccccccta

SEQ ID NO: 1423 - DNA, 32 bp, Artificial Sequence
  Synthetic polynucleotide
agaagggatcggtgacctctcctttaggtcgg

SEQ ID NO: 1424 - DNA, 32 bp, Artificial Sequence
  Synthetic polynucleotide
cgacctgaaatccggggcgaagctttcgcgtg

SEQ ID NO: 1425 - DNA, 32 bp, Artificial Sequence
  Synthetic polynucleotide
ctataacgtatcgtgctttcaccgagttgagt

SEQ ID NO: 1426 - DNA, 32 bp, Artificial Sequence
  Synthetic polynucleotide
ttttttttttggcaaagactattgtttttttt

SEQ ID NO: 1427 - DNA, 32 bp, Artificial Sequence
  Synthetic polynucleotide
ttcgtgtggcttaacattgcggtaacggctag

SEQ ID NO: 1428 - DNA, 32 bp, Artificial Sequence
  Synthetic polynucleotide
tatcaggacccccgaagtcgggtcgccgtaaa

SEQ ID NO: 1429 - DNA, 32 bp, Artificial Sequence
  Synthetic polynucleotide
tcaccgcgtgctcgcgacacagttcgtcgatc

SEQ ID NO: 1430 - DNA, 32 bp, Artificial Sequence
  Synthetic polynucleotide
tctgagtcccgtcatgagggattgatctatcc

SEQ ID NO: 1431 - DNA, 32 bp, Artificial Sequence
  Synthetic polynucleotide
cgagttgacatatccgtactcctgttgcagtt

SEQ ID NO: 1432 - DNA, 32 bp, Artificial Sequence
  Synthetic polynucleotide
ttggccttagtgtgtaagcttaattagtaagg

SEQ ID NO: 1433 - DNA, 32 bp, Artificial Sequence
  Synthetic polynucleotide
acttgattaaacgcgtgtcaagacctgcccat

SEQ ID NO: 1434 - DNA, 32 bp, Artificial Sequence
  Synthetic polynucleotide
ttttttttttcgccctgtagatcctttttttt

SEQ ID NO: 1435 - DNA, 32 bp, Artificial Sequence
  Synthetic polynucleotide
acgttgttcggggcataaatgtgaggtggcaa

SEQ ID NO: 1436 - DNA, 32 bp, Artificial Sequence
  Synthetic polynucleotide
agggccaaaatgagacgggtacaaaacccgtg

SEQ ID NO: 1437 - DNA, 32 bp, Artificial Sequence
  Synthetic polynucleotide
acgtccgaaggcgaggcccaataagccagaga

SEQ ID NO: 1438 - DNA, 32 bp, Artificial Sequence
  Synthetic polynucleotide
acagggagcgcgtgtatgccacacagatctag

SEQ ID NO: 1439 - DNA, 32 bp, Artificial Sequence
  Synthetic polynucleotide
ccgaaaatccaacaggatcccttgttgctata

SEQ ID NO: 1440 - DNA, 32 bp, Artificial Sequence
  Synthetic polynucleotide
acagccttaacaaaatttaagagccctttatc

SEQ ID NO: 1441 - DNA, 32 bp, Artificial Sequence
  Synthetic polynucleotide
atccgctttactctaaattactttccctccca

SEQ ID NO: 1442 - DNA, 32 bp, Artificial Sequence
  Synthetic polynucleotide
ttttttttacgctcgatagtgacgtttttttt

SEQ ID NO: 1443 - DNA, 32 bp, Artificial Sequence
  Synthetic polynucleotide
cctatcaccaagcgggtctcgatagccaagga

SEQ ID NO: 1444 - DNA, 32 bp, Artificial Sequence
  Synthetic polynucleotide
gtgttaacgctgagagttatttactataccaa

SEQ ID NO: 1445 - DNA, 32 bp, Artificial Sequence
  Synthetic polynucleotide
aatctcgtactccgctgttaacattcgcttta

SEQ ID NO: 1446 - DNA, 32 bp, Artificial Sequence
  Synthetic polynucleotide
cctgtctaacgaatacgacgccccaaagtcta

SEQ ID NO: 1447 - DNA, 32 bp, Artificial Sequence
  Synthetic polynucleotide
gtgctctgcggcaatacagaattattgcgctg

SEQ ID NO: 1448 - DNA, 32 bp, Artificial Sequence
  Synthetic polynucleotide
tctataacggcgtgtagtctacagaaggaacg

SEQ ID NO: 1449 - DNA, 32 bp, Artificial Sequence
  Synthetic polynucleotide
cttaaccgtgtattcttcccgtctcagccctc

SEQ ID NO: 1450 - DNA, 32 bp, Artificial Sequence
  Synthetic polynucleotide
ttttttttcagttgcccggcattatttttttt

SEQ ID NO: 1451 - DNA, 32 bp, Artificial Sequence
  Synthetic polynucleotide
ctaactatttggaatgtgattgagttgtcggg

SEQ ID NO: 1452 - DNA, 32 bp, Artificial Sequence
  Synthetic polynucleotide
aaactaaacctagtcaagttacaagctctgga

SEQ ID NO: 1453 - DNA, 32 bp, Artificial Sequence
  Synthetic polynucleotide
gtcgttacctaacgcgcattacgacgattgct

SEQ ID NO: 1454 - DNA, 32 bp, Artificial Sequence
  Synthetic polynucleotide
tttcatagagttggtctccttactcagtcgcc

SEQ ID NO: 1455 - DNA, 32 bp, Artificial Sequence
  Synthetic polynucleotide
gaggccttagtgcgcccgtaccccacaccgat

SEQ ID NO: 1456 - DNA, 32 bp, Artificial Sequence
  Synthetic polynucleotide
agcagtaccctgcctaaacaaggaaatcttgg

SEQ ID NO: 1457 - DNA, 32 bp, Artificial Sequence
  Synthetic polynucleotide
tctttgcaagtatggagacgaaggccctggag

SEQ ID NO: 1458 - DNA, 32 bp, Artificial Sequence
  Synthetic polynucleotide
ttttttttggaaggtcgcctacgttttttttt

SEQ ID NO: 1459 - DNA, 32 bp, Artificial Sequence
  Synthetic polynucleotide
ggtcacactgtgtggatcaggatcgtgtttcc

SEQ ID NO: 1460 - DNA, 32 bp, Artificial Sequence
  Synthetic polynucleotide
gtaccgcaagcgctatttatgtcgggcctcag

SEQ ID NO: 1461 - DNA, 32 bp, Artificial Sequence
  Synthetic polynucleotide
agtgtaagtatcggttagtaaacagtcactgc

SEQ ID NO: 1462 - DNA, 32 bp, Artificial Sequence
  Synthetic polynucleotide
gatgtcaactcccgaatttaagttggtcgggt

SEQ ID NO: 1463 - DNA, 32 bp, Artificial Sequence
  Synthetic polynucleotide
ttgtgatcttaatttaatggttatcacagcgc

SEQ ID NO: 1464 - DNA, 32 bp, Artificial Sequence
  Synthetic polynucleotide
ttggtgcatgccatataaacttcttgtttgat

SEQ ID NO: 1465 - DNA, 32 bp, Artificial Sequence
  Synthetic polynucleotide
tgttgagggtctttagctacattttcccccca

SEQ ID NO: 1466 - DNA, 32 bp, Artificial Sequence
  Synthetic polynucleotide
ttttttttattcaagacccctgcgtttttttt

SEQ ID NO: 1467 - DNA, 32 bp, Artificial Sequence
  Synthetic polynucleotide
ccatatcagtaatctcttactccgggcttcat

SEQ ID NO: 1468 - DNA, 32 bp, Artificial Sequence
  Synthetic polynucleotide
gtgtaagaattttggacgttctagtcttcacc

SEQ ID NO: 1469 - DNA, 32 bp, Artificial Sequence
  Synthetic polynucleotide
aactgcgctcctacccgaaggagcgcaatagg

SEQ ID NO: 1470 - DNA, 32 bp, Artificial Sequence
  Synthetic polynucleotide
atcccgttatcaaggaatccgaaggagccgat

SEQ ID NO: 1471 - DNA, 32 bp, Artificial Sequence
  Synthetic polynucleotide
cctacgcccccttcccgaaaactgcccgaagc

SEQ ID NO: 1472 - DNA, 32 bp, Artificial Sequence
  Synthetic polynucleotide
cgctgtaagtgcggccgtttagtgcaacccat

SEQ ID NO: 1473 - DNA, 32 bp, Artificial Sequence
  Synthetic polynucleotide
tgacagaacgaggcgtccggggaacccgttta

SEQ ID NO: 1474 - DNA, 32 bp, Artificial Sequence
  Synthetic polynucleotide
ttttttttgtagacatgactttgttttttttt

SEQ ID NO: 1475 - DNA, 32 bp, Artificial Sequence
  Synthetic polynucleotide
cgggcccaggagagcattccaggcagtatgaa

SEQ ID NO: 1476 - DNA, 32 bp, Artificial Sequence
  Synthetic polynucleotide
aaccatttacaaaccctctttgctatgcataa

SEQ ID NO: 1477 - DNA, 32 bp, Artificial Sequence
  Synthetic polynucleotide
atattacacaatatacagtatccatgaaagaa

SEQ ID NO: 1478 - DNA, 32 bp, Artificial Sequence
  Synthetic polynucleotide
acaactgtagtacccacaccaggtacttaacc

SEQ ID NO: 1479 - DNA, 32 bp, Artificial Sequence
  Synthetic polynucleotide
aagcctgttcatttgcacgggtaccgaaactc

SEQ ID NO: 1480 - DNA, 32 bp, Artificial Sequence
  Synthetic polynucleotide
tccaataacggcgacggcaggtggagtccttc

SEQ ID NO: 1481 - DNA, 32 bp, Artificial Sequence
  Synthetic polynucleotide
tttcataaccgacatcacctctcttagacatt

SEQ ID NO: 1482 - DNA, 32 bp, Artificial Sequence
  Synthetic polynucleotide
ttttttttcacccgcctcaacccctttttttt

SEQ ID NO: 1483 - DNA, 32 bp, Artificial Sequence
  Synthetic polynucleotide
tagagaccaaagaagtgttcgactccgaagtt

SEQ ID NO: 1484 - DNA, 32 bp, Artificial Sequence
  Synthetic polynucleotide
ggtcctctcacggcttctggttttatattgaa

SEQ ID NO: 1485 - DNA, 32 bp, Artificial Sequence
  Synthetic polynucleotide
gcccccgtaaacataccacgtagtaattatgc

SEQ ID NO: 1486 - DNA, 32 bp, Artificial Sequence
  Synthetic polynucleotide
catgtaggaagtgtgatttcgtaagggctcac

SEQ ID NO: 1487 - DNA, 32 bp, Artificial Sequence
  Synthetic polynucleotide
cgcaagctctttatttccaacggggctgataa

SEQ ID NO: 1488 - DNA, 32 bp, Artificial Sequence
  Synthetic polynucleotide
cgtaaaacctagctagacacactcccctcaca

SEQ ID NO: 1489 - DNA, 32 bp, Artificial Sequence
  Synthetic polynucleotide
ccggatgctttgctaccagactcttgtgttga

SEQ ID NO: 1490 - DNA, 32 bp, Artificial Sequence
  Synthetic polynucleotide
ttttttttttcctgaagctggggatttttttt

SEQ ID NO: 1491 - DNA, 32 bp, Artificial Sequence
  Synthetic polynucleotide
acattcatcatggtcccggactaatggatact

SEQ ID NO: 1492 - DNA, 32 bp, Artificial Sequence
  Synthetic polynucleotide
cccgctgatgacgggtcgttgcacattgtacc

SEQ ID NO: 1493 - DNA, 32 bp, Artificial Sequence
  Synthetic polynucleotide
gccatacaaagagtgactcttgcctttacatc

SEQ ID NO: 1494 - DNA, 32 bp, Artificial Sequence
  Synthetic polynucleotide
gggtggtctattagtacttatccttcaccagg

SEQ ID NO: 1495 - DNA, 32 bp, Artificial Sequence
  Synthetic polynucleotide
ttggtttatcgagtctcggcgttaaacgtcta

SEQ ID NO: 1496 - DNA, 32 bp, Artificial Sequence
  Synthetic polynucleotide
tgaacccttgacccttgtggtccaattcatgg

SEQ ID NO: 1497 - DNA, 32 bp, Artificial Sequence
  Synthetic polynucleotide
tattattaggcatgggaccactggaacggtcc

SEQ ID NO: 1498 - DNA, 32 bp, Artificial Sequence
  Synthetic polynucleotide
ttttttttggttatgcggtcggattttttttt

SEQ ID NO: 1499 - DNA, 32 bp, Artificial Sequence
  Synthetic polynucleotide
aagttagccactaataagcacaggtgggaccc

SEQ ID NO: 1500 - DNA, 32 bp, Artificial Sequence
  Synthetic polynucleotide
gacgcttatttcaggtcgactgacctgaggac

SEQ ID NO: 1501 - DNA, 32 bp, Artificial Sequence
  Synthetic polynucleotide
caatcagggaggaggacaggcagcatttgcca

SEQ ID NO: 1502 - DNA, 32 bp, Artificial Sequence
  Synthetic polynucleotide
cctaccctctctatataattatccgtcgatga

SEQ ID NO: 1503 - DNA, 32 bp, Artificial Sequence
  Synthetic polynucleotide
ggctggttcctctacggtattggataggacaa

SEQ ID NO: 1504 - DNA, 32 bp, Artificial Sequence
  Synthetic polynucleotide
taacaccaccagcgtaaggtaactagcattcc

SEQ ID NO: 1505 - DNA, 32 bp, Artificial Sequence
  Synthetic polynucleotide
taacggcttaacaaacggtcaactgacatgct

SEQ ID NO: 1506 - DNA, 32 bp, Artificial Sequence
  Synthetic polynucleotide
ttttttttcgcataccctgtaccgtttttttt

SEQ ID NO: 1507 - DNA, 32 bp, Artificial Sequence
  Synthetic polynucleotide
tgacacttatagacggatcggtcgtaagaggt

SEQ ID NO: 1508 - DNA, 32 bp, Artificial Sequence
  Synthetic polynucleotide
gactcgaggaactagtactgcgagggccgaaa

SEQ ID NO: 1509 - DNA, 32 bp, Artificial Sequence
  Synthetic polynucleotide
cacaacccaacctgaggcagtttcgttcaaca

SEQ ID NO: 1510 - DNA, 32 bp, Artificial Sequence
  Synthetic polynucleotide
gatgactgacccccgcttgcggcattcctggg

SEQ ID NO: 1511 - DNA, 32 bp, Artificial Sequence
  Synthetic polynucleotide
aaggtatatcgtacatctcatttgaggtagtc

SEQ ID NO: 1512 - DNA, 32 bp, Artificial Sequence
  Synthetic polynucleotide
taccctacatctcattcgtgctaggtgatcct

SEQ ID NO: 1513 - DNA, 32 bp, Artificial Sequence
  Synthetic polynucleotide
gagagctacccagcggttagcaggcgcgaagg

SEQ ID NO: 1514 - DNA, 32 bp, Artificial Sequence
  Synthetic polynucleotide
tttttttttatagcttgatatggctttttttt

SEQ ID NO: 1515 - DNA, 32 bp, Artificial Sequence
  Synthetic polynucleotide
tattgtgcagggcaactgtgtccgatagacgg

SEQ ID NO: 1516 - DNA, 32 bp, Artificial Sequence
  Synthetic polynucleotide
tttataccattctgctattaccagcatcgaat

SEQ ID NO: 1517 - DNA, 32 bp, Artificial Sequence
  Synthetic polynucleotide
ttagcaactttattgctatgacagataaaact

SEQ ID NO: 1518 - DNA, 32 bp, Artificial Sequence
  Synthetic polynucleotide
gcgaagttcaagtgccgactatgcgcaccgga

SEQ ID NO: 1519 - DNA, 32 bp, Artificial Sequence
  Synthetic polynucleotide
cctgatgtaatatgtctctcgtgcgtgagcac

SEQ ID NO: 1520 - DNA, 32 bp, Artificial Sequence
  Synthetic polynucleotide
tggttaggcacgcaaagtatttgcatcatctc

SEQ ID NO: 1521 - DNA, 32 bp, Artificial Sequence
  Synthetic polynucleotide
ttgtcggggctgatcaagatcatcccaacgtg

SEQ ID NO: 1522 - DNA, 32 bp, Artificial Sequence
  Synthetic polynucleotide
tttttttttttcaaagtatccccatttttttt

SEQ ID NO: 1523 - DNA, 32 bp, Artificial Sequence
  Synthetic polynucleotide
gccgttcttcaccctatgctaactgtatgacg

SEQ ID NO: 1524 - DNA, 32 bp, Artificial Sequence
  Synthetic polynucleotide
ggcgggcagtgagacgaaatcttcattcctga

SEQ ID NO: 1525 - DNA, 32 bp, Artificial Sequence
  Synthetic polynucleotide
gagatacaaactctgatcggactggtggaaaa

SEQ ID NO: 1526 - DNA, 32 bp, Artificial Sequence
  Synthetic polynucleotide
cgtaaaacgggcccgtctaattacagctaccg

SEQ ID NO: 1527 - DNA, 32 bp, Artificial Sequence
  Synthetic polynucleotide
agccgccgccgttcaccgtggatcgtcttgag

SEQ ID NO: 1528 - DNA, 32 bp, Artificial Sequence
  Synthetic polynucleotide
taaccctgacgggttggtcctacatgattcaa

SEQ ID NO: 1529 - DNA, 32 bp, Artificial Sequence
  Synthetic polynucleotide
agttgcaatagggtcaactacttacctaaggt

SEQ ID NO: 1530 - DNA, 32 bp, Artificial Sequence
  Synthetic polynucleotide
ttttttttgaatcttaatagtcattttttttt

SEQ ID NO: 1531 - DNA, 48 bp, Artificial Sequence
  Synthetic polynucleotide
cagggtacccgcgtaatgcatattccaagcatgcttaactaggagcag

SEQ ID NO: 1532 - DNA, 32 bp, Artificial Sequence
  Synthetic polynucleotide
ccagaccgtagcggtctatgacgaggggacaa

SEQ ID NO: 1533 - DNA, 48 bp, Artificial Sequence
  Synthetic polynucleotide
cctacacccctcacagttggggcgtccacgaagattatgctataccat

SEQ ID NO: 1534 - DNA, 32 bp, Artificial Sequence
  Synthetic polynucleotide
gcacgtattgggcgtattaaatgggagatccc

SEQ ID NO: 1535 - DNA, 48 bp, Artificial Sequence
  Synthetic polynucleotide
ctgagcgttgcgcgaggcctcttatccaaaagatatcgttagccgatg

SEQ ID NO: 1536 - DNA, 32 bp, Artificial Sequence
  Synthetic polynucleotide
ggcttgcacagaccggtacccttattgatagt

SEQ ID NO: 1537 - DNA, 48 bp, Artificial Sequence
  Synthetic polynucleotide
gcgcggttcaggtgagagtgacaaacagagattcttcaggtttttttt

SEQ ID NO: 1538 - DNA, 32 bp, Artificial Sequence
  Synthetic polynucleotide
ttttttttagacttagtaacctgctttttttt

SEQ ID NO: 1539 - DNA, 48 bp, Artificial Sequence
  Synthetic polynucleotide
accttttagcaagccgcattgacgagcaaacatcggttgtggctcccg

SEQ ID NO: 1540 - DNA, 32 bp, Artificial Sequence
  Synthetic polynucleotide
tcccaatcttacttctctaatacggtaggagt

SEQ ID NO: 1541 - DNA, 48 bp, Artificial Sequence
  Synthetic polynucleotide
gctggacgctggactcgttccttctcttgcagggaagacctgactgtg

SEQ ID NO: 1542 - DNA, 32 bp, Artificial Sequence
  Synthetic polynucleotide
acccatggacagatgcgtggtggggctcgctg

SEQ ID NO: 1543 - DNA, 48 bp, Artificial Sequence
  Synthetic polynucleotide
attcccagacagcagtatgtcaggcaaggacataacctcaagcaagca

SEQ ID NO: 1544 - DNA, 32 bp, Artificial Sequence
  Synthetic polynucleotide
aaattgtgcttacctaaatgcccacatatttt

SEQ ID NO: 1545 - DNA, 48 bp, Artificial Sequence
  Synthetic polynucleotide
tgcgaaaacttccagctccactgcgatgaaggcgccagggtttttttt

SEQ ID NO: 1546 - DNA, 32 bp, Artificial Sequence
  Synthetic polynucleotide
ttttttttgatgtgccagatgtagtttttttt

SEQ ID NO: 1547 - DNA, 16 bp, Artificial Sequence
  Synthetic polynucleotide
gggttagatcgttacg

SEQ ID NO: 1548 - DNA, 48 bp, Artificial Sequence
  Synthetic polynucleotide
tcatgcatatactgtccagaccactcgtagccgtaggctcagatggca

SEQ ID NO: 1549 - DNA, 48 bp, Artificial Sequence
  Synthetic polynucleotide
atcgcggaaactgtacattccatgtaggaaaatggtcgcaggaagcct

SEQ ID NO: 1550 - DNA, 48 bp, Artificial Sequence
  Synthetic polynucleotide
aagtccgtcccaaatgtagagcaccggacgaaaggtcgggcgcaccac

SEQ ID NO: 1551 - DNA, 32 bp, Artificial Sequence
  Synthetic polynucleotide
ttttttttacttgatgttaccctctttttttt

SEQ ID NO: 1552 - DNA, 16 bp, Artificial Sequence
  Synthetic polynucleotide
cgattggttgttttaa

SEQ ID NO: 1553 - DNA, 48 bp, Artificial Sequence
  Synthetic polynucleotide
cgactggggggactgctcccccgatttgtgtagaccaggtctcctagg

SEQ ID NO: 1554 - DNA, 48 bp, Artificial Sequence
  Synthetic polynucleotide
caccggacaggcccacctaccgatctgccttggtagtttaaaatctga

SEQ ID NO: 1555 - DNA, 48 bp, Artificial Sequence
  Synthetic polynucleotide
gcccttattaggtatggagcaaggatctcgtaatgctagcgccacacg

SEQ ID NO: 1556 - DNA, 32 bp, Artificial Sequence
  Synthetic polynucleotide
ttttttttgaagaatcgattctaatttttttt

SEQ ID NO: 1557 - DNA, 48 bp, Artificial Sequence
  Synthetic polynucleotide
aagcatggttttttttttttttttcccacgtcccagtctgacctctat

SEQ ID NO: 1558 - DNA, 32 bp, Artificial Sequence
  Synthetic polynucleotide
tactcgtcagaatagagttgtgccccaaagtt

SEQ ID NO: 1559 - DNA, 48 bp, Artificial Sequence
  Synthetic polynucleotide
gatgctggaaaccggataacctaaaaaggaaagcagtgtgtctgtctc

SEQ ID NO: 1560 - DNA, 32 bp, Artificial Sequence
  Synthetic polynucleotide
ccataagacgaaccacccgcgggcccacgtgg

SEQ ID NO: 1561 - DNA, 48 bp, Artificial Sequence
  Synthetic polynucleotide
aactctagtactccattctgtcctcgcaccaccgtactgactggccac

SEQ ID NO: 1562 - DNA, 32 bp, Artificial Sequence
  Synthetic polynucleotide
agatacaatctactacttcgtacacaactatt

SEQ ID NO: 1563 - DNA, 48 bp, Artificial Sequence
  Synthetic polynucleotide
ctgacgaccacctgcagaaaaagaggatacctggcgccggactctgaa

SEQ ID NO: 1564 - DNA, 32 bp, Artificial Sequence
  Synthetic polynucleotide
tccggtgacttggcgaatttaaatgctcctca

SEQ ID NO: 1565 - DNA, 48 bp, Artificial Sequence
  Synthetic polynucleotide
gtaccctaagactctatttatcaattttttttttttttttccttgatc

SEQ ID NO: 1566 - DNA, 48 bp, Artificial Sequence
  Synthetic polynucleotide
gccaagtctatggacgatagctgaggatgaaagacgacgagttcctca

SEQ ID NO: 1567 - DNA, 48 bp, Artificial Sequence
  Synthetic polynucleotide
ggcccgagtctattggtagaaccctgagaggtttatgtctcaggcgta

SEQ ID NO: 1568 - DNA, 48 bp, Artificial Sequence
  Synthetic polynucleotide
tattgaaaaggaacccgtttcgtcttcccagtcccagataaagatgta

SEQ ID NO: 1569 - DNA, 16 bp, Artificial Sequence
  Synthetic polynucleotide
ttttttttcagacaag

SEQ ID NO: 1570 - DNA, 32 bp, Artificial Sequence
  Synthetic polynucleotide
cactagtcttttttttttttttttcgctccgg

SEQ ID NO: 1571 - DNA, 48 bp, Artificial Sequence
  Synthetic polynucleotide
gcttatagtgcctcatgacgttagtcggcgcctggcattggtaggccg

SEQ ID NO: 1572 - DNA, 32 bp, Artificial Sequence
  Synthetic polynucleotide
acgtgttcgcgtgacctacagaggaacgaggt

SEQ ID NO: 1573 - DNA, 48 bp, Artificial Sequence
  Synthetic polynucleotide
gaatacaaaacctcgaactcgtccccaccgggcaggatagaaggagta

SEQ ID NO: 1574 - DNA, 32 bp, Artificial Sequence
  Synthetic polynucleotide
cagagtacaagcggtctgctcctcctactttt

SEQ ID NO: 1575 - DNA, 48 bp, Artificial Sequence
  Synthetic polynucleotide
gacgtcagactgtcttgacagaagaagggccaagccattgtcggtcga

SEQ ID NO: 1576 - DNA, 32 bp, Artificial Sequence
  Synthetic polynucleotide
tgaagtcccatgactctgacgccccgagtttg

SEQ ID NO: 1577 - DNA, 32 bp, Artificial Sequence
  Synthetic polynucleotide
ctgtatggtgctcgaggatttcaaaaggagaa

SEQ ID NO: 1578 - DNA, 16 bp, Artificial Sequence
  Synthetic polynucleotide
catcaccatttttttt

SEQ ID NO: 1579 - DNA, 48 bp, Artificial Sequence
  Synthetic polynucleotide
tctattatttactcactctgcttagtgtattgtacgaaacaaactgaa

SEQ ID NO: 1580 - DNA, 48 bp, Artificial Sequence
  Synthetic polynucleotide
cgcgcgctctggagagaagggtcgcatcggtcattatgactgtcatat

SEQ ID NO: 1581 - DNA, 48 bp, Artificial Sequence
  Synthetic polynucleotide
tcgaacgctgtctagttacaatgggaagcaattggcactcccctaatc

SEQ ID NO: 1582 - DNA, 32 bp, Artificial Sequence
  Synthetic polynucleotide
acccgctaggtgggctggtcttaggtcaattc

SEQ ID NO: 1583 - DNA, 48 bp, Artificial Sequence
  Synthetic polynucleotide
gggggtggttttttttttttttttacaaatgcgagttatcttgcggtc

SEQ ID NO: 1584 - DNA, 32 bp, Artificial Sequence
  Synthetic polynucleotide
cgggggctctgaagtcgtgcagccgtcgtgat

SEQ ID NO: 1585 - DNA, 48 bp, Artificial Sequence
  Synthetic polynucleotide
gaactaaccccaaattgacttaggccggatggaatcggaaaatttgta

SEQ ID NO: 1586 - DNA, 32 bp, Artificial Sequence
  Synthetic polynucleotide
cacctctcgcttgccatgactgtaaaagggaa

SEQ ID NO: 1587 - DNA, 48 bp, Artificial Sequence
  Synthetic polynucleotide
cagagagtgataccctcaaccagggcctgcaaaagaacagttccgtgc

SEQ ID NO: 1588 - DNA, 32 bp, Artificial Sequence
  Synthetic polynucleotide
gactaaagttacgcctctcgctttttgctctt

SEQ ID NO: 1589 - DNA, 48 bp, Artificial Sequence
  Synthetic polynucleotide
cgcttttaacgtaaggacaaaaattggacgtacagtgataggtcttcg

SEQ ID NO: 1590 - DNA, 32 bp, Artificial Sequence
  Synthetic polynucleotide
agtgggttttggagtgtttctttttctcggta

SEQ ID NO: 1591 - DNA, 48 bp, Artificial Sequence
  Synthetic polynucleotide
ctttagattttcgagggcgcatagttttttttttttttttaccggaat

SEQ ID NO: 1592 - DNA, 48 bp, Artificial Sequence
  Synthetic polynucleotide
tcccttactgttctgatcttcacgggaggtgctcccccataggaaact

SEQ ID NO: 1593 - DNA, 48 bp, Artificial Sequence
  Synthetic polynucleotide
gagcgagaaccattactttcttattttagtgcaagtcaagatgttctc

SEQ ID NO: 1594 - DNA, 48 bp, Artificial Sequence
  Synthetic polynucleotide
ggaacacaaaggtgtcaatctttgttatggtgaggacttgtagcgatg

SEQ ID NO: 1595 - DNA, 16 bp, Artificial Sequence
  Synthetic polynucleotide
ttttttttacaagaag

SEQ ID NO: 1596 - DNA, 32 bp, Artificial Sequence
  Synthetic polynucleotide
ggctatctttttttttttttttttcctttgac

SEQ ID NO: 1597 - DNA, 48 bp, Artificial Sequence
  Synthetic polynucleotide
atggggttaggactgggtgtaatctccattcagttttacgcgttgaat

SEQ ID NO: 1598 - DNA, 32 bp, Artificial Sequence
  Synthetic polynucleotide
gcctgtgccctatgtcctgcttcgctgtccgt

SEQ ID NO: 1599 - DNA, 48 bp, Artificial Sequence
  Synthetic polynucleotide
ggtcagtccttgaatatgcatcaatcagatcccgcttctcacccagag

SEQ ID NO: 1600 - DNA, 32 bp, Artificial Sequence
  Synthetic polynucleotide
gttaaccatctaaggcagggtgtaacttagcg

SEQ ID NO: 1601 - DNA, 48 bp, Artificial Sequence
  Synthetic polynucleotide
tctatctgttcggctctcagcactcagtggtacttgagcatttcaaaa

SEQ ID NO: 1602 - DNA, 32 bp, Artificial Sequence
  Synthetic polynucleotide
gaagaattagctccatttagaatcgccatact

SEQ ID NO: 1603 - DNA, 32 bp, Artificial Sequence
  Synthetic polynucleotide
gttgctcgcagcttcgaaattgcacgatacca

SEQ ID NO: 1604 - DNA, 16 bp, Artificial Sequence
  Synthetic polynucleotide
aatgagaatttttttt

SEQ ID NO: 1605 - DNA, 48 bp, Artificial Sequence
  Synthetic polynucleotide
aagccaatcatgccatcggcgcatggtcgacgacaatgacgaaatcgc

SEQ ID NO: 1606 - DNA, 48 bp, Artificial Sequence
  Synthetic polynucleotide
gggttactatattgtatcagtgaagcgacgaaacggcccgtgccgtaa

SEQ ID NO: 1607 - DNA, 48 bp, Artificial Sequence
  Synthetic polynucleotide
gtgaattttgcgcccataggcccccattgacgccgagccagtctcgcc

SEQ ID NO: 1608 - DNA, 32 bp, Artificial Sequence
  Synthetic polynucleotide
cccgcaagtagtctcggaacctttacttacca

SEQ ID NO: 1609 - DNA, 48 bp, Artificial Sequence
  Synthetic polynucleotide
gcgtgctgttttttttttttttttacgccgccttatcgcattattcct

SEQ ID NO: 1610 - DNA, 32 bp, Artificial Sequence
  Synthetic polynucleotide
gagttattaaccttctcggtcagtacttcggc

SEQ ID NO: 1611 - DNA, 48 bp, Artificial Sequence
  Synthetic polynucleotide
gttgcgataatagcccagtgtagtgtgacaccgctgggacgctcatat

SEQ ID NO: 1612 - DNA, 32 bp, Artificial Sequence
  Synthetic polynucleotide
agcccgatccgaggctggagggctacttaaag

SEQ ID NO: 1613 - DNA, 48 bp, Artificial Sequence
  Synthetic polynucleotide
gtacagctaatgagagaggcggatctctttgaagggagttcccggcga

SEQ ID NO: 1614 - DNA, 32 bp, Artificial Sequence
  Synthetic polynucleotide
gctgtttggatttacgcaaagtgacggcccgt

SEQ ID NO: 1615 - DNA, 48 bp, Artificial Sequence
  Synthetic polynucleotide
gcccgtgagcgcttttccggctgttacgacgggtcacatgcgcgattc

SEQ ID NO: 1616 - DNA, 32 bp, Artificial Sequence
  Synthetic polynucleotide
tgtcgtgcgcggtttaatagtaaccatatccg

SEQ ID NO: 1617 - DNA, 48 bp, Artificial Sequence
  Synthetic polynucleotide
tcgctgaaccgaggcccccattcttttttttttttttttttcaaataa

SEQ ID NO: 1618 - DNA, 48 bp, Artificial Sequence
  Synthetic polynucleotide
cctgaatagctgatcttgaggctctcatttctggcgtttaacaggcat

SEQ ID NO: 1619 - DNA, 48 bp, Artificial Sequence
  Synthetic polynucleotide
atgcggctagctcggggagaaacaaaaggagagattttgccatagtga

SEQ ID NO: 1620 - DNA, 48 bp, Artificial Sequence
  Synthetic polynucleotide
gagtcaagaacagtaatgtgctccactgccaacaaggtcgcgaagact

SEQ ID NO: 1621 - DNA, 16 bp, Artificial Sequence
  Synthetic polynucleotide
tttttttttcaggcgc

SEQ ID NO: 1622 - DNA, 32 bp, Artificial Sequence
  Synthetic polynucleotide
tgtgttagttttttttttttttttaaagtggc

SEQ ID NO: 1623 - DNA, 48 bp, Artificial Sequence
  Synthetic polynucleotide
gtgcttgtaagcagcgcgcctgtatgactagactgccgacctgaaaac

SEQ ID NO: 1624 - DNA, 32 bp, Artificial Sequence
  Synthetic polynucleotide
ggaaacatggcttatgtgtcgcttctgtcctg

SEQ ID NO: 1625 - DNA, 48 bp, Artificial Sequence
  Synthetic polynucleotide
atagtgatgacccggcccagtgaagcactcgactcaacataggatgag

SEQ ID NO: 1626 - DNA, 32 bp, Artificial Sequence
  Synthetic polynucleotide
ccaatctggtctgaacaggaggcacgtaacca

SEQ ID NO: 1627 - DNA, 48 bp, Artificial Sequence
  Synthetic polynucleotide
tccctcgcaacaacccgcacacagaaccctaatgcggacaaggcacca

SEQ ID NO: 1628 - DNA, 32 bp, Artificial Sequence
  Synthetic polynucleotide
tgtaaaaacctgctgagcagacctagcggctc

SEQ ID NO: 1629 - DNA, 32 bp, Artificial Sequence
  Synthetic polynucleotide
accgacaacttcattccacggagaacggtctt

SEQ ID NO: 1630 - DNA, 16 bp, Artificial Sequence
  Synthetic polynucleotide
cctctgtgtttttttt

SEQ ID NO: 1631 - DNA, 48 bp, Artificial Sequence
  Synthetic polynucleotide
agccagcacgctcttgtacgccacccataactgtggctacaacggcgc

SEQ ID NO: 1632 - DNA, 48 bp, Artificial Sequence
  Synthetic polynucleotide
tacactcttcgtcgtatgtcacggactgggctcctccagacgcgtgcc

SEQ ID NO: 1633 - DNA, 48 bp, Artificial Sequence
  Synthetic polynucleotide
cgcgcttaacaaaggggtggacaagattaattcattggtgacctgttg

SEQ ID NO: 1634 - DNA, 32 bp, Artificial Sequence
  Synthetic polynucleotide
aagaccaaccgcaaccttgttggctatgttcc

SEQ ID NO: 1635 - DNA, 48 bp, Artificial Sequence
  Synthetic polynucleotide
aacaatttttttttttttttttttgtgttagctcgagccgcccttcag

SEQ ID NO: 1636 - DNA, 32 bp, Artificial Sequence
  Synthetic polynucleotide
tgtcgactccctaacctgagctggccgctaca

SEQ ID NO: 1637 - DNA, 48 bp, Artificial Sequence
  Synthetic polynucleotide
gtaccgcggcacgtttaatggtagtatgatctggatccaatgttagcg

SEQ ID NO: 1638 - DNA, 32 bp, Artificial Sequence
  Synthetic polynucleotide
gcaactcagcccagggttacccggttatacaa

SEQ ID NO: 1639 - DNA, 48 bp, Artificial Sequence
  Synthetic polynucleotide
ggtagccaacggctaactggtaacccgtgccctagaatgattgtgggt

SEQ ID NO: 1640 - DNA, 32 bp, Artificial Sequence
  Synthetic polynucleotide
agtcatccccctaactaaagtgtgtgagttcg

SEQ ID NO: 1641 - DNA, 48 bp, Artificial Sequence
  Synthetic polynucleotide
agacgtccgatgtaagaacacgctaaaccaagcagcggagtgcggtta

SEQ ID NO: 1642 - DNA, 32 bp, Artificial Sequence
  Synthetic polynucleotide
cggaacccctctacgttgagcgcgtgtcggcg

SEQ ID NO: 1643 - DNA, 48 bp, Artificial Sequence
  Synthetic polynucleotide
ctccgaggcaacaacattctaatgttttttttttttttttccccggcc

SEQ ID NO: 1644 - DNA, 48 bp, Artificial Sequence
  Synthetic polynucleotide
gctttacgacgtgacccagacgcgtacttgccattttcgggtagaagt

SEQ ID NO: 1645 - DNA, 48 bp, Artificial Sequence
  Synthetic polynucleotide
tttgcgtgtaatcacgaggagtcaaagggctgccaaatagtaacttta

SEQ ID NO: 1646 - DNA, 48 bp, Artificial Sequence
  Synthetic polynucleotide
ctatatgggagcgaaattcgacataaacctcggcgttgtgtgtatccc

SEQ ID NO: 1647 - DNA, 16 bp, Artificial Sequence
  Synthetic polynucleotide
tttttttttagccatt

SEQ ID NO: 1648 - DNA, 32 bp, Artificial Sequence
  Synthetic polynucleotide
agttaccgttttttttttttttttgtggataa

SEQ ID NO: 1649 - DNA, 48 bp, Artificial Sequence
  Synthetic polynucleotide
cgcgcctgacccaatatttcggcactccctaaatcaccacccgattca

SEQ ID NO: 1650 - DNA, 32 bp, Artificial Sequence
  Synthetic polynucleotide
gtgtcaagtcctccgatgaatgaccggctttt

SEQ ID NO: 1651 - DNA, 48 bp, Artificial Sequence
  Synthetic polynucleotide
tcgaattaccacgcatcaactagtgtcgagtggtatgctctccaaacc

SEQ ID NO: 1652 - DNA, 32 bp, Artificial Sequence
  Synthetic polynucleotide
tgagcctggtgccgtatgaaaggattgattaa

SEQ ID NO: 1653 - DNA, 48 bp, Artificial Sequence
  Synthetic polynucleotide
gctgcctctgacaattttagtatcgccgactcgggatcgttatactgc

SEQ ID NO: 1654 - DNA, 32 bp, Artificial Sequence
  Synthetic polynucleotide
catgcctctttccaacaccggcacattagtac

SEQ ID NO: 1655 - DNA, 32 bp, Artificial Sequence
  Synthetic polynucleotide
gtagacggtcaacggtcatactttacagtcag

SEQ ID NO: 1656 - DNA, 16 bp, Artificial Sequence
  Synthetic polynucleotide
aagaggcgtttttttt

SEQ ID NO: 1657 - DNA, 48 bp, Artificial Sequence
  Synthetic polynucleotide
ctgcggtatacagatgaccgcgtgattttccgcaagtgatagacgaga

SEQ ID NO: 1658 - DNA, 48 bp, Artificial Sequence
  Synthetic polynucleotide
gatataatacggagccctcgcgctgctccgatggccattggttcttag

SEQ ID NO: 1659 - DNA, 48 bp, Artificial Sequence
  Synthetic polynucleotide
tcagtgtctcaggggcagtgcgttgatggtctaaggttattaaacaaa

SEQ ID NO: 1660 - DNA, 32 bp, Artificial Sequence
  Synthetic polynucleotide
ggttgcgtcagcgtagctggtcactgacgccc

SEQ ID NO: 1661 - DNA, 48 bp, Artificial Sequence
  Synthetic polynucleotide
aggcggagttttttttttttttttcgttgcgtgaaacacaaatgccgc

SEQ ID NO: 1662 - DNA, 32 bp, Artificial Sequence
  Synthetic polynucleotide
gagaccttcgtgacggtatactgcattccaac

SEQ ID NO: 1663 - DNA, 48 bp, Artificial Sequence
  Synthetic polynucleotide
ggagtaaattggattcgttaattatgaacgattatggccgcatgatat

SEQ ID NO: 1664 - DNA, 32 bp, Artificial Sequence
  Synthetic polynucleotide
aacggatgtatacggattgagctacaaacatt

SEQ ID NO: 1665 - DNA, 48 bp, Artificial Sequence
  Synthetic polynucleotide
tcgcctcaacaatgctaaacagatcgaagtgcattatacaacaagact

SEQ ID NO: 1666 - DNA, 32 bp, Artificial Sequence
  Synthetic polynucleotide
ttttcagaccgatctcaaaaatgagccgtgat

SEQ ID NO: 1667 - DNA, 48 bp, Artificial Sequence
  Synthetic polynucleotide
gtggatctagttactaagcccagaattggcgggttgggacgctcggtc

SEQ ID NO: 1668 - DNA, 32 bp, Artificial Sequence
  Synthetic polynucleotide
cattctacgaaaactacgtgcacaggacggtt

SEQ ID NO: 1669 - DNA, 48 bp, Artificial Sequence
  Synthetic polynucleotide
aattttcacatatcccagcgccaattttttttttttttttaggtgcgt

SEQ ID NO: 1670 - DNA, 48 bp, Artificial Sequence
  Synthetic polynucleotide
ttggttcagatatagaagaacttgcactatccatacagctattcaatt

SEQ ID NO: 1671 - DNA, 48 bp, Artificial Sequence
  Synthetic polynucleotide
atcaaccacgtgcgcgcgagcgcgaaaacctgcgaagtgatggtgtgc

SEQ ID NO: 1672 - DNA, 48 bp, Artificial Sequence
  Synthetic polynucleotide
cccaatgatccctgttcaaacgagtgattaagaagtgccgttcctgtg

SEQ ID NO: 1673 - DNA, 16 bp, Artificial Sequence
  Synthetic polynucleotide
ttttttttagccgggg

SEQ ID NO: 1674 - DNA, 32 bp, Artificial Sequence
  Synthetic polynucleotide
catataccttttttttttttttttaagagtct

SEQ ID NO: 1675 - DNA, 48 bp, Artificial Sequence
  Synthetic polynucleotide
ccccataatcgctcatgggcgttcttagcgcgccccagacgcaattgg

SEQ ID NO: 1676 - DNA, 32 bp, Artificial Sequence
  Synthetic polynucleotide
taagatagcttacttgtggtacctatccacta

SEQ ID NO: 1677 - DNA, 48 bp, Artificial Sequence
  Synthetic polynucleotide
attcttctcccgaatcggaagggattgggtctggtcgcgcctggacaa

SEQ ID NO: 1678 - DNA, 32 bp, Artificial Sequence
  Synthetic polynucleotide
agggcttagatctcatgggtatttggcaaata

SEQ ID NO: 1679 - DNA, 48 bp, Artificial Sequence
  Synthetic polynucleotide
ataactcctgactcggtcgagaacaccggtagctgtaccttggaacca

SEQ ID NO: 1680 - DNA, 32 bp, Artificial Sequence
  Synthetic polynucleotide
acttgtagctatcatttgattacgtgccttag

SEQ ID NO: 1681 - DNA, 32 bp, Artificial Sequence
  Synthetic polynucleotide
ggcggcatcctccatcggaagtagacttacgc

SEQ ID NO: 1682 - DNA, 16 bp, Artificial Sequence
  Synthetic polynucleotide
agagttaatttttttt

SEQ ID NO: 1683 - DNA, 48 bp, Artificial Sequence
  Synthetic polynucleotide
ccggtgtcatctcgccgagattgttggcaagccggtgtccggggcatc

SEQ ID NO: 1684 - DNA, 48 bp, Artificial Sequence
  Synthetic polynucleotide
cctgtaagttgaacgagtagaagaaagcagtccaaggcggactagcgg

SEQ ID NO: 1685 - DNA, 48 bp, Artificial Sequence
  Synthetic polynucleotide
gttcactagaacgaccaatgaggaaggcgattcacatggattactcgt

SEQ ID NO: 1686 - DNA, 32 bp, Artificial Sequence
  Synthetic polynucleotide
atgaagttaccatattcactcatgaacctgcc

SEQ ID NO: 1687 - DNA, 48 bp, Artificial Sequence
  Synthetic polynucleotide
acgtaatattttttttttttttttatgaattacgtccgaaattcggat

SEQ ID NO: 1688 - DNA, 32 bp, Artificial Sequence
  Synthetic polynucleotide
cgtggagcgccgccggagcggtcttgattatt

SEQ ID NO: 1689 - DNA, 48 bp, Artificial Sequence
  Synthetic polynucleotide
tcttttgttcccggcatgcaccgcctaagggtatcggtaggtatacgg

SEQ ID NO: 1690 - DNA, 32 bp, Artificial Sequence
  Synthetic polynucleotide
cttgggattgcgacaaagaacccaatcgtatt

SEQ ID NO: 1691 - DNA, 48 bp, Artificial Sequence
  Synthetic polynucleotide
gactcgtacctcgttgtcaggaaccgtggcataagggctatgaggtgg

SEQ ID NO: 1692 - DNA, 32 bp, Artificial Sequence
  Synthetic polynucleotide
cacacggacctttcgggccttagtagtaggag

SEQ ID NO: 1693 - DNA, 48 bp, Artificial Sequence
  Synthetic polynucleotide
acgtgtgacaatagcggtacagatgagccgctcttaccataatatatc

SEQ ID NO: 1694 - DNA, 32 bp, Artificial Sequence
  Synthetic polynucleotide
cgcacccaccccaagtaagcgatacgatgcag

SEQ ID NO: 1695 - DNA, 48 bp, Artificial Sequence
  Synthetic polynucleotide
aatgtcgaactcaacaggagcgctttttttttttttttttctttcgac

SEQ ID NO: 1696 - DNA, 48 bp, Artificial Sequence
  Synthetic polynucleotide
cttttatacagggtgcgcccgttctaatacggcaacgccttcagatga

SEQ ID NO: 1697 - DNA, 48 bp, Artificial Sequence
  Synthetic polynucleotide
tcgggttcaccgagtaaggcgaacggctcaattggaacatcctctact

SEQ ID NO: 1698 - DNA, 48 bp, Artificial Sequence
  Synthetic polynucleotide
tgtccgcatcataggaacgcatattgcgaaggtcaatctctcgctatg

SEQ ID NO: 1699 - DNA, 16 bp, Artificial Sequence
  Synthetic polynucleotide
ttttttttgtgatcat

SEQ ID NO: 1700 - DNA, 32 bp, Artificial Sequence
  Synthetic polynucleotide
gaagtatgtttttttttttttttttcacggtt

SEQ ID NO: 1701 - DNA, 48 bp, Artificial Sequence
  Synthetic polynucleotide
ccaaatgaaaggactctggttaaggattggtcccccacatcgggctct

SEQ ID NO: 1702 - DNA, 32 bp, Artificial Sequence
  Synthetic polynucleotide
caaactatcacgcgtatgggattccacaggga

SEQ ID NO: 1703 - DNA, 48 bp, Artificial Sequence
  Synthetic polynucleotide
tgtccttcaaatggcggattggttggcaaagacccgtagtgtagagta

SEQ ID NO: 1704 - DNA, 32 bp, Artificial Sequence
  Synthetic polynucleotide
ctagcagaacgtggttacacggatggccaggt

SEQ ID NO: 1705 - DNA, 48 bp, Artificial Sequence
  Synthetic polynucleotide
gacccgagaccagggattccgactagcacgagccctaatttgagtgta

SEQ ID NO: 1706 - DNA, 32 bp, Artificial Sequence
  Synthetic polynucleotide
tctctcccatgaattaacgatagtgacccatc

SEQ ID NO: 1707 - DNA, 32 bp, Artificial Sequence
  Synthetic polynucleotide
ctgacagtcggggattcttgaagttgctagat

SEQ ID NO: 1708 - DNA, 16 bp, Artificial Sequence
  Synthetic polynucleotide
cgaaggcttttttttt

SEQ ID NO: 1709 - DNA, 48 bp, Artificial Sequence
  Synthetic polynucleotide
ataggggctcatcagttgcgtttcaagtggcttggacctcgatgacgg

SEQ ID NO: 1710 - DNA, 48 bp, Artificial Sequence
  Synthetic polynucleotide
atgacttttgaccgataaccacaaccatagtcttacaggatccgattc

SEQ ID NO: 1711 - DNA, 48 bp, Artificial Sequence
  Synthetic polynucleotide
ggtctcattctgtcagttgctcgccgcctctttatcaactggcgcctc

SEQ ID NO: 1712 - DNA, 32 bp, Artificial Sequence
  Synthetic polynucleotide
cgggaggctgcagtatccttatcctgtttcag

SEQ ID NO: 1713 - DNA, 48 bp, Artificial Sequence
  Synthetic polynucleotide
ttaggttaatagaggtcagactgggacgtgggtggtgatgcaatacac

SEQ ID NO: 1714 - DNA, 48 bp, Artificial Sequence
  Synthetic polynucleotide
aggacagagagacagacacactgctttcctttataatagagaccgatg

SEQ ID NO: 1715 - DNA, 48 bp, Artificial Sequence
  Synthetic polynucleotide
tctttttcgtggccagtcagtacggtggtgcgagcgcgcgattgcttc

SEQ ID NO: 1716 - DNA, 48 bp, Artificial Sequence
  Synthetic polynucleotide
ttttttttttcagagtccggcgccaggtatccgcgttcgaagcccacc

SEQ ID NO: 1717 - DNA, 16 bp, Artificial Sequence
  Synthetic polynucleotide
ccatgctttctattct

SEQ ID NO: 1718 - DNA, 48 bp, Artificial Sequence
  Synthetic polynucleotide
tcgtcgtcaactttggggcacaacgatcaagggactagtgatgaggca

SEQ ID NO: 1719 - DNA, 48 bp, Artificial Sequence
  Synthetic polynucleotide
agacataaccacgtgggcccgcggtgaggaacgaacacgttcgaggtt

SEQ ID NO: 1720 - DNA, 48 bp, Artificial Sequence
  Synthetic polynucleotide
tatctgggaatagttgtgtacgaatacgcctggtactctgaagacagt

SEQ ID NO: 1721 - DNA, 48 bp, Artificial Sequence
  Synthetic polynucleotide
tttttttttgaggagcatttaaattacatcttggacttcactcgagca

SEQ ID NO: 1722 - DNA, 16 bp, Artificial Sequence
  Synthetic polynucleotide
ttgataaatagagtct

SEQ ID NO: 1723 - DNA, 32 bp, Artificial Sequence
  Synthetic polynucleotide
ctaacgtccttgtctgctatgcgccctcgaaa

SEQ ID NO: 1724 - DNA, 48 bp, Artificial Sequence
  Synthetic polynucleotide
caatgccaggcgccgatagggtactttcatcctcagctatcgtccata

SEQ ID NO: 1725 - DNA, 32 bp, Artificial Sequence
  Synthetic polynucleotide
ggacgagtcggcctaccgtgaagatcagaaca

SEQ ID NO: 1726 - DNA, 48 bp, Artificial Sequence
  Synthetic polynucleotide
ctatcctgcccggtgggacttggcacctctcagggttctaccaataga

SEQ ID NO: 1727 - DNA, 32 bp, Artificial Sequence
  Synthetic polynucleotide
cttctgtctactccttataagaaagtaatggt

SEQ ID NO: 1728 - DNA, 48 bp, Artificial Sequence
  Synthetic polynucleotide
caatggcttggcccttctcgggccactgggaagacgaaacgggttcct

SEQ ID NO: 1729 - DNA, 32 bp, Artificial Sequence
  Synthetic polynucleotide
ttgaaatctcgaccgacaaagattgacacctt

SEQ ID NO: 1730 - DNA, 32 bp, Artificial Sequence
  Synthetic polynucleotide
ttttttttttctcctttttcaatatttttttt

SEQ ID NO: 1731 - DNA, 32 bp, Artificial Sequence
  Synthetic polynucleotide
gtttcgtaccggagcgccacccccgacttcag

SEQ ID NO: 1732 - DNA, 48 bp, Artificial Sequence
  Synthetic polynucleotide
cctctgtattcagtttgacgagtatccggtttccagcatcgtggttcg

SEQ ID NO: 1733 - DNA, 32 bp, Artificial Sequence
  Synthetic polynucleotide
gtcataatacctcgttgttagttctggcaagc

SEQ ID NO: 1734 - DNA, 48 bp, Artificial Sequence
  Synthetic polynucleotide
gaggagcaatatgacatcttatggatggagtactagagttgtagtaga

SEQ ID NO: 1735 - DNA, 32 bp, Artificial Sequence
  Synthetic polynucleotide
gagtgccaaaaagtagactctctgaggcgtaa

SEQ ID NO: 1736 - DNA, 48 bp, Artificial Sequence
  Synthetic polynucleotide
gggcgtcagattagggttgtatcttgcaggtggtcgtcagtcgccaag

SEQ ID NO: 1737 - DNA, 32 bp, Artificial Sequence
  Synthetic polynucleotide
ctaagacccaaactcgtaaaagcgcactccaa

SEQ ID NO: 1738 - DNA, 32 bp, Artificial Sequence
  Synthetic polynucleotide
ttttttttgaattgactcaccggatttttttt

SEQ ID NO: 1739 - DNA, 32 bp, Artificial Sequence
  Synthetic polynucleotide
gataactcgcatttgtttctcattcgtcgacc

SEQ ID NO: 1740 - DNA, 32 bp, Artificial Sequence
  Synthetic polynucleotide
cctaagtcgaccgcaataagcagagtgagtaa

SEQ ID NO: 1741 - DNA, 32 bp, Artificial Sequence
  Synthetic polynucleotide
ttccgattccatccggattggcttttcgtcgc

SEQ ID NO: 1742 - DNA, 32 bp, Artificial Sequence
  Synthetic polynucleotide
cctggttgtacaaattcgacccttctctccag

SEQ ID NO: 1743 - DNA, 32 bp, Artificial Sequence
  Synthetic polynucleotide
ctgttcttttgcaggcagtaaccccgtcaatg

SEQ ID NO: 1744 - DNA, 32 bp, Artificial Sequence
  Synthetic polynucleotide
atttttgtgcacggaaccattgtaactagaca

SEQ ID NO: 1745 - DNA, 32 bp, Artificial Sequence
  Synthetic polynucleotide
tatcactgtacgtccaaaattcaccgagacta

SEQ ID NO: 1746 - DNA, 32 bp, Artificial Sequence
  Synthetic polynucleotide
ttttttttcgaagacctagcgggttttttttt

SEQ ID NO: 1747 - DNA, 32 bp, Artificial Sequence
  Synthetic polynucleotide
ggctgcacattccggtagatagccccagtcct

SEQ ID NO: 1748 - DNA, 32 bp, Artificial Sequence
  Synthetic polynucleotide
atgggggaatcacgacctataagcggtcacgc

SEQ ID NO: 1749 - DNA, 32 bp, Artificial Sequence
  Synthetic polynucleotide
tacagtcaagtttcctgcacaggctattcaag

SEQ ID NO: 1750 - DNA, 32 bp, Artificial Sequence
  Synthetic polynucleotide
cttgacttttccctttttgtattcgaccgctt

SEQ ID NO: 1751 - DNA, 32 bp, Artificial Sequence
  Synthetic polynucleotide
aaagcgaggagaacattggttaacgagccgaa

SEQ ID NO: 1752 - DNA, 32 bp, Artificial Sequence
  Synthetic polynucleotide
caagtcctaagagcaactgacgtcgagtcatg

SEQ ID NO: 1753 - DNA, 32 bp, Artificial Sequence
  Synthetic polynucleotide
aaaagaaacatcgctaaattcttccgaagctg

SEQ ID NO: 1754 - DNA, 32 bp, Artificial Sequence
  Synthetic polynucleotide
tttttttttaccgagaccatacagtttttttt

SEQ ID NO: 1755 - DNA, 32 bp, Artificial Sequence
  Synthetic polynucleotide
gattacaccttcttgtagaatgggggcctcgg

SEQ ID NO: 1756 - DNA, 32 bp, Artificial Sequence
  Synthetic polynucleotide
cgtaaaactgaatggaatctaaaggcacctcc

SEQ ID NO: 1757 - DNA, 32 bp, Artificial Sequence
  Synthetic polynucleotide
ttgatgcaattcaacggagcctcaagatcagc

SEQ ID NO: 1758 - DNA, 32 bp, Artificial Sequence
  Synthetic polynucleotide
gagaagcgggatctgagtaagggagcactaaa

SEQ ID NO: 1759 - DNA, 32 bp, Artificial Sequence
  Synthetic polynucleotide
agtgctgactctgggttgtttctccccgagct

SEQ ID NO: 1760 - DNA, 32 bp, Artificial Sequence
  Synthetic polynucleotide
tgctcaagtaccactgtctcgctccaccataa

SEQ ID NO: 1761 - DNA, 32 bp, Artificial Sequence
  Synthetic polynucleotide
tgcaatttttttgaaaggagcacattactgtt

SEQ ID NO: 1762 - DNA, 32 bp, Artificial Sequence
  Synthetic polynucleotide
tttttttttggtatcgtgtgttcctttttttt

SEQ ID NO: 1763 - DNA, 32 bp, Artificial Sequence
  Synthetic polynucleotide
gtcattgtgtcaaaggcagcacgcagaaggtt

SEQ ID NO: 1764 - DNA, 32 bp, Artificial Sequence
  Synthetic polynucleotide
cgaagcaggcgatttcagcccccgaatttggg

SEQ ID NO: 1765 - DNA, 32 bp, Artificial Sequence
  Synthetic polynucleotide
cgggccgtacggacagatcgcaacagcctcgg

SEQ ID NO: 1766 - DNA, 32 bp, Artificial Sequence
  Synthetic polynucleotide
tacaccctttacggcagagaggtgagggtatc

SEQ ID NO: 1767 - DNA, 32 bp, Artificial Sequence
  Synthetic polynucleotide
tggctcggcgctaagtagctgtaccgtaaatc

SEQ ID NO: 1768 - DNA, 32 bp, Artificial Sequence
  Synthetic polynucleotide
gattctaaggcgagacctttagtcccttacgt

SEQ ID NO: 1769 - DNA, 32 bp, Artificial Sequence
  Synthetic polynucleotide
aaaggttcagtatggctcacgggctaaaccgc

SEQ ID NO: 1770 - DNA, 32 bp, Artificial Sequence
  Synthetic polynucleotide
tttttttttggtaagtaacccacttttttttt

SEQ ID NO: 1771 - DNA, 32 bp, Artificial Sequence
  Synthetic polynucleotide
tgcgataaggcggcgtcacagaggagttatgg

SEQ ID NO: 1772 - DNA, 32 bp, Artificial Sequence
  Synthetic polynucleotide
actacactaggaataaatgcgccgatggcatg

SEQ ID NO: 1773 - DNA, 32 bp, Artificial Sequence
  Synthetic polynucleotide
gtcccagcggtgtcactgctggctagcccagt

SEQ ID NO: 1774 - DNA, 32 bp, Artificial Sequence
  Synthetic polynucleotide
atccgcctatatgagcttcactgatacaatat

SEQ ID NO: 1775 - DNA, 32 bp, Artificial Sequence
  Synthetic polynucleotide
aactcccttcaaagagagagtgtaaattaatc

SEQ ID NO: 1776 - DNA, 32 bp, Artificial Sequence
  Synthetic polynucleotide
acagccggtcgccgggggggcctatgggcgca

SEQ ID NO: 1777 - DNA, 32 bp, Artificial Sequence
  Synthetic polynucleotide
catgtgacccgtcgtataagcgcgggttgcgg

SEQ ID NO: 1778 - DNA, 32 bp, Artificial Sequence
  Synthetic polynucleotide
ttttttttgaatcgcgcttgcgggtttttttt

SEQ ID NO: 1779 - DNA, 32 bp, Artificial Sequence
  Synthetic polynucleotide
actgaccgttatttgactaacacacgctgctt

SEQ ID NO: 1780 - DNA, 32 bp, Artificial Sequence
  Synthetic polynucleotide
taaacgccgccgaagtaaccccatgacatagg

SEQ ID NO: 1781 - DNA, 32 bp, Artificial Sequence
  Synthetic polynucleotide
agccctccatgcctgtatgtttccgccgggtc

SEQ ID NO: 1782 - DNA, 32 bp, Artificial Sequence
  Synthetic polynucleotide
gcaaaatcctttaagtgactgaccgccttaga

SEQ ID NO: 1783 - DNA, 32 bp, Artificial Sequence
  Synthetic polynucleotide
tcactttgtcactatgcagattgggggttgtt

SEQ ID NO: 1784 - DNA, 32 bp, Artificial Sequence
  Synthetic polynucleotide
cgaccttgacgggccgcagatagaatggagct

SEQ ID NO: 1785 - DNA, 32 bp, Artificial Sequence
  Synthetic polynucleotide
gttactatagtcttcgtttttacagaatgaag

SEQ ID NO: 1786 - DNA, 32 bp, Artificial Sequence
  Synthetic polynucleotide
ttttttttcggatatgcgagcaactttttttt

SEQ ID NO: 1787 - DNA, 32 bp, Artificial Sequence
  Synthetic polynucleotide
tacaggcggcgcctgacattagaatgttgttg

SEQ ID NO: 1788 - DNA, 32 bp, Artificial Sequence
  Synthetic polynucleotide
gtcggcagtctagtcattcagcgaagaaatga

SEQ ID NO: 1789 - DNA, 32 bp, Artificial Sequence
  Synthetic polynucleotide
ttcactgggttttcagcgcgtctgggtcacgt

SEQ ID NO: 1790 - DNA, 32 bp, Artificial Sequence
  Synthetic polynucleotide
atgttgagtcgagtgctattcaggtctccttt

SEQ ID NO: 1791 - DNA, 32 bp, Artificial Sequence
  Synthetic polynucleotide
ctgtgtgcctcatccttgactcctcgtgatta

SEQ ID NO: 1792 - DNA, 32 bp, Artificial Sequence
  Synthetic polynucleotide
tgtccgcattagggttagccgcatttggcagt

SEQ ID NO: 1793 - DNA, 32 bp, Artificial Sequence
  Synthetic polynucleotide
tctccgtgtggtgcctatgtcgaatttcgctc

SEQ ID NO: 1794 - DNA, 32 bp, Artificial Sequence
  Synthetic polynucleotide
ttttttttaagaccgtcttgactctttttttt

SEQ ID NO: 1795 - DNA, 32 bp, Artificial Sequence
  Synthetic polynucleotide
gtagccacgccactttaaattgttggttaggg

SEQ ID NO: 1796 - DNA, 32 bp, Artificial Sequence
  Synthetic polynucleotide
aagcgacagcgccgttaataactcgggctatt

SEQ ID NO: 1797 - DNA, 32 bp, Artificial Sequence
  Synthetic polynucleotide
tctggaggcaggacagcgcggtacccctgggc

SEQ ID NO: 1798 - DNA, 32 bp, Artificial Sequence
  Synthetic polynucleotide
tgcctcctggcacgcgatcgggctctctcatt

SEQ ID NO: 1799 - DNA, 32 bp, Artificial Sequence
  Synthetic polynucleotide
caccaatgtggttacgtggctaccagttaggg

SEQ ID NO: 1800 - DNA, 32 bp, Artificial Sequence
  Synthetic polynucleotide
aggtctgccaacaggtcaaacagcaaaagcgc

SEQ ID NO: 1801 - DNA, 32 bp, Artificial Sequence
  Synthetic polynucleotide
gccaacaagagccgctggacgtctacgtagag

SEQ ID NO: 1802 - DNA, 32 bp, Artificial Sequence
  Synthetic polynucleotide
ttttttttggaacatagcacgacatttttttt

SEQ ID NO: 1803 - DNA, 32 bp, Artificial Sequence
  Synthetic polynucleotide
cggctcgagctaacaccgcctcttcggaaaat

SEQ ID NO: 1804 - DNA, 32 bp, Artificial Sequence
  Synthetic polynucleotide
ctaccattctgaaggggtggcgtacaagagcg

SEQ ID NO: 1805 - DNA, 32 bp, Artificial Sequence
  Synthetic polynucleotide
ttggatccagatcatataccgcagatcggagc

SEQ ID NO: 1806 - DNA, 32 bp, Artificial Sequence
  Synthetic polynucleotide
gttaccagcgctaacaccgtgacatacgacga

SEQ ID NO: 1807 - DNA, 32 bp, Artificial Sequence
  Synthetic polynucleotide
tcattctagggcacggattatatcagaccatc

SEQ ID NO: 1808 - DNA, 32 bp, Artificial Sequence
  Synthetic polynucleotide
agcgtgttacccacaattgtccacccctttgt

SEQ ID NO: 1809 - DNA, 32 bp, Artificial Sequence
  Synthetic polynucleotide
ctccgctgcttggtttgacactgactacgctg

SEQ ID NO: 1810 - DNA, 32 bp, Artificial Sequence
  Synthetic polynucleotide
tttttttttaaccgcattggtctttttttttt

SEQ ID NO: 1811 - DNA, 32 bp, Artificial Sequence
  Synthetic polynucleotide
ccagctcaggccggggcggtaacttattgggt

SEQ ID NO: 1812 - DNA, 32 bp, Artificial Sequence
  Synthetic polynucleotide
ccgaaaattgtagcggacaagcaccataagcc

SEQ ID NO: 1813 - DNA, 32 bp, Artificial Sequence
  Synthetic polynucleotide
ccgggtaaacttctaccttgacacatgcgtgg

SEQ ID NO: 1814 - DNA, 32 bp, Artificial Sequence
  Synthetic polynucleotide
ctatttggttgtataaatcactatgttcagac

SEQ ID NO: 1815 - DNA, 32 bp, Artificial Sequence
  Synthetic polynucleotide
cacacttttaaagttacaggctcaaattgtca

SEQ ID NO: 1816 - DNA, 32 bp, Artificial Sequence
  Synthetic polynucleotide
cacaacgccgaactcagcgagggatcagcagg

SEQ ID NO: 1817 - DNA, 32 bp, Artificial Sequence
  Synthetic polynucleotide
cgcgctcagggatacagaggcatgaccgttga

SEQ ID NO: 1818 - DNA, 32 bp, Artificial Sequence
  Synthetic polynucleotide
ttttttttcgccgacattgtcggttttttttt

SEQ ID NO: 1819 - DNA, 32 bp, Artificial Sequence
  Synthetic polynucleotide
tgccgaaaaatggctattggcgctgggatatg

SEQ ID NO: 1820 - DNA, 32 bp, Artificial Sequence
  Synthetic polynucleotide
gtggtgatttagggagcctcggagggcaagta

SEQ ID NO: 1821 - DNA, 32 bp, Artificial Sequence
  Synthetic polynucleotide
actagttgtgaatcggcaagttcttctatatc

SEQ ID NO: 1822 - DNA, 32 bp, Artificial Sequence
  Synthetic polynucleotide
gagcataccactcgaccgtaaagccagccctt

SEQ ID NO: 1823 - DNA, 32 bp, Artificial Sequence
  Synthetic polynucleotide
gatactaaggtttggacgcgctcgcgcgcacg

SEQ ID NO: 1824 - DNA, 32 bp, Artificial Sequence
  Synthetic polynucleotide
acgatcccgagtcggccacgcaaacgaggttt

SEQ ID NO: 1825 - DNA, 32 bp, Artificial Sequence
  Synthetic polynucleotide
aaagtatggcagtatactcgtttgaacaggga

SEQ ID NO: 1826 - DNA, 32 bp, Artificial Sequence
  Synthetic polynucleotide
ttttttttctgactgtccatatagtttttttt

SEQ ID NO: 1827 - DNA, 32 bp, Artificial Sequence
  Synthetic polynucleotide
atcacttgttatccacctccgcctccgtcacg

SEQ ID NO: 1828 - DNA, 32 bp, Artificial Sequence
  Synthetic polynucleotide
gtcattcatctcgtctagtcgacaaaacgtgc

SEQ ID NO: 1829 - DNA, 32 bp, Artificial Sequence
  Synthetic polynucleotide
caatggccaaaagccgtttactcctccgtata

SEQ ID NO: 1830 - DNA, 32 bp, Artificial Sequence
  Synthetic polynucleotide
tcctttcactaagaactgagttgcttagccgt

SEQ ID NO: 1831 - DNA, 32 bp, Artificial Sequence
  Synthetic polynucleotide
ataaccttttaatcaatgaggcgagagatcgg

SEQ ID NO: 1832 - DNA, 32 bp, Artificial Sequence
  Synthetic polynucleotide
gtgccggttttgtttaggatgactcttacatc

SEQ ID NO: 1833 - DNA, 32 bp, Artificial Sequence
  Synthetic polynucleotide
gtgaccaggtactaatagatccactagttttc

SEQ ID NO: 1834 - DNA, 32 bp, Artificial Sequence
  Synthetic polynucleotide
ttttttttgggcgtcagggttccgtttttttt

SEQ ID NO: 1835 - DNA, 32 bp, Artificial Sequence
  Synthetic polynucleotide
tgtgtttcacgcaacgttaactctgcttgcca

SEQ ID NO: 1836 - DNA, 32 bp, Artificial Sequence
  Synthetic polynucleotide
taattaacgcggcattcacgcggtcatctgta

SEQ ID NO: 1837 - DNA, 32 bp, Artificial Sequence
  Synthetic polynucleotide
cggccataatcgttcagacaccgggactgctt

SEQ ID NO: 1838 - DNA, 32 bp, Artificial Sequence
  Synthetic polynucleotide
atctgtttatatcatgagcgcgagggctccgt

SEQ ID NO: 1839 - DNA, 32 bp, Artificial Sequence
  Synthetic polynucleotide
tgtataatgcacttcgcttacaggaatcgcct

SEQ ID NO: 1840 - DNA, 32 bp, Artificial Sequence
  Synthetic polynucleotide
tctgggctagtcttgtaacgcactgcccctga

SEQ ID NO: 1841 - DNA, 32 bp, Artificial Sequence
  Synthetic polynucleotide
gtcccaacccgccaattagtgaacaatatggt

SEQ ID NO: 1842 - DNA, 32 bp, Artificial Sequence
  Synthetic polynucleotide
ttttttttgaccgagcacgcaacctttttttt

SEQ ID NO: 1843 - DNA, 32 bp, Artificial Sequence
  Synthetic polynucleotide
gcagtataacgcacctggtatatgatgagcga

SEQ ID NO: 1844 - DNA, 32 bp, Artificial Sequence
  Synthetic polynucleotide
agctgtatgttggaatcaggcgcgtcggagga

SEQ ID NO: 1845 - DNA, 32 bp, Artificial Sequence
  Synthetic polynucleotide
tagctcaaaattgaatctatcttagattcggg

SEQ ID NO: 1846 - DNA, 32 bp, Artificial Sequence
  Synthetic polynucleotide
tcacttcgaatgtttgtaattcgatacggcac

SEQ ID NO: 1847 - DNA, 32 bp, Artificial Sequence
  Synthetic polynucleotide
tcatttttgcacaccataagccctccgagtca

SEQ ID NO: 1848 - DNA, 32 bp, Artificial Sequence
  Synthetic polynucleotide
cggcacttatcacggcgaggcagcgttggaaa

SEQ ID NO: 1849 - DNA, 32 bp, Artificial Sequence
  Synthetic polynucleotide
tgtgcacgcacaggaactacaagtgatggagg

SEQ ID NO: 1850 - DNA, 32 bp, Artificial Sequence
  Synthetic polynucleotide
ttttttttaaccgtccccgtctactttttttt

SEQ ID NO: 1851 - DNA, 32 bp, Artificial Sequence
  Synthetic polynucleotide
gaacgcccccccggctagcgctcctgttgagt

SEQ ID NO: 1852 - DNA, 32 bp, Artificial Sequence
  Synthetic polynucleotide
gtctggggcgcgctaatgaaaattggatagtg

SEQ ID NO: 1853 - DNA, 32 bp, Artificial Sequence
  Synthetic polynucleotide
tcccttccccaattgcgaacgggcgcaccctg

SEQ ID NO: 1854 - DNA, 32 bp, Artificial Sequence
  Synthetic polynucleotide
gcgcgaccagacccaatgaaccaacaggtttt

SEQ ID NO: 1855 - DNA, 32 bp, Artificial Sequence
  Synthetic polynucleotide
gttctcgattgtccaggttcgccttactcggt

SEQ ID NO: 1856 - DNA, 32 bp, Artificial Sequence
  Synthetic polynucleotide
aggtacagctaccggttggttgatcttaatca

SEQ ID NO: 1857 - DNA, 32 bp, Artificial Sequence
  Synthetic polynucleotide
ctacttcctggttccaatatgcgttcctatga

SEQ ID NO: 1858 - DNA, 32 bp, Artificial Sequence
  Synthetic polynucleotide
ttttttttgcgtaagttcattgggtttttttt

SEQ ID NO: 1859 - DNA, 32 bp, Artificial Sequence
  Synthetic polynucleotide
ggacaccgagactctttattacgtccggcggc

SEQ ID NO: 1860 - DNA, 32 bp, Artificial Sequence
  Synthetic polynucleotide
aggtaccagatgccccaaggtctcgaatccaa

SEQ ID NO: 1861 - DNA, 32 bp, Artificial Sequence
  Synthetic polynucleotide
ccgccttgtagtggatacaaaagattgtcgca

SEQ ID NO: 1862 - DNA, 32 bp, Artificial Sequence
  Synthetic polynucleotide
aaatacccccgctagtcatccgttagcattgt

SEQ ID NO: 1863 - DNA, 32 bp, Artificial Sequence
  Synthetic polynucleotide
tccatgtgtatttgcctacgagtcccgaaagg

SEQ ID NO: 1864 - DNA, 32 bp, Artificial Sequence
  Synthetic polynucleotide
cgtaatcaacgagtaatctgaaaatagtaact

SEQ ID NO: 1865 - DNA, 32 bp, Artificial Sequence
  Synthetic polynucleotide
catgagtgctaaggcatcacacgtacttgggg

SEQ ID NO: 1866 - DNA, 32 bp, Artificial Sequence
  Synthetic polynucleotide
ttttttttggcaggttgtagaatgtttttttt

SEQ ID NO: 1867 - DNA, 48 bp, Artificial Sequence
  Synthetic polynucleotide
ttcggacgtaattcatagccttcgagccacttgaaacgcaactgatga

SEQ ID NO: 1868 - DNA, 32 bp, Artificial Sequence
  Synthetic polynucleotide
gcggtgcaatccgaatacaatctcggcgagat

SEQ ID NO: 1869 - DNA, 48 bp, Artificial Sequence
  Synthetic polynucleotide
ctaccgatacccttaggcccctatgactatggttgtggttatcggtca

SEQ ID NO: 1870 - DNA, 32 bp, Artificial Sequence
  Synthetic polynucleotide
gttcctgaccgtatactcttctactcgttcaa

SEQ ID NO: 1871 - DNA, 48 bp, Artificial Sequence
  Synthetic polynucleotide
tagcccttatgccacgaaagtcataagaggcggcgagcaactgacaga

SEQ ID NO: 1872 - DNA, 32 bp, Artificial Sequence
  Synthetic polynucleotide
atctgtacccacctcatcctcattggtcgttc

SEQ ID NO: 1873 - DNA, 48 bp, Artificial Sequence
  Synthetic polynucleotide
atggtaagagcggctcatgagaccatactgcagcctcccgtttttttt

SEQ ID NO: 1874 - DNA, 32 bp, Artificial Sequence
  Synthetic polynucleotide
ttttttttgatatattaacttcattttttttt

SEQ ID NO: 1875 - DNA, 48 bp, Artificial Sequence
  Synthetic polynucleotide
agaccgctgtcgaaagcatacttcgagtcctttcatttggtacgcgtg

SEQ ID NO: 1876 - DNA, 32 bp, Artificial Sequence
  Synthetic polynucleotide
aggcgttgaataatcattatggggcaagtaag

SEQ ID NO: 1877 - DNA, 48 bp, Artificial Sequence
  Synthetic polynucleotide
tgggttcttcatctgaatagtttgcgccatttgaaggacaaaccacgt

SEQ ID NO: 1878 - DNA, 32 bp, Artificial Sequence
  Synthetic polynucleotide
atgttccaaatacgatagaagaatatgagatc

SEQ ID NO: 1879 - DNA, 48 bp, Artificial Sequence
  Synthetic polynucleotide
actaaggcagtagaggtctgctagtccctggtctcgggtctaattcat

SEQ ID NO: 1880 - DNA, 32 bp, Artificial Sequence
  Synthetic polynucleotide
gagattgactcctactggagttataatgatag

SEQ ID NO: 1881 - DNA, 48 bp, Artificial Sequence
  Synthetic polynucleotide
tatcgcttcatagcgagggagagaaatccccgactgtcagtttttttt

SEQ ID NO: 1882 - DNA, 32 bp, Artificial Sequence
  Synthetic polynucleotide
ttttttttctgcatcgatgccgcctttttttt

SEQ ID NO: 1883 - DNA, 16 bp, Artificial Sequence
  Synthetic polynucleotide
cttaaccaatgatcac

SEQ ID NO: 1884 - DNA, 48 bp, Artificial Sequence
  Synthetic polynucleotide
aaccaatcagagcccgatgtgggggaccaatctcgacattccgtatta

SEQ ID NO: 1885 - DNA, 48 bp, Artificial Sequence
  Synthetic polynucleotide
agtcggaatactctacactacgggtctttgcctataaaagattgagcc

SEQ ID NO: 1886 - DNA, 48 bp, Artificial Sequence
  Synthetic polynucleotide
acttcaagtacactcaaattagggctcgtgctgaacccgaccttcgca

SEQ ID NO: 1887 - DNA, 32 bp, Artificial Sequence
  Synthetic polynucleotide
ttttttttatctagcatgcggacatttttttt

SEQ ID NO: 1888 - DNA, 16 bp, Artificial Sequence
  Synthetic polynucleotide
gaggtccaaaccgtga

SEQ ID NO: 1889 - DNA, 48 bp, Artificial Sequence
  Synthetic polynucleotide
tcctgtaatccctgtggaatcccaccgtcatcgctccacgtgccggga

SEQ ID NO: 1890 - DNA, 48 bp, Artificial Sequence
  Synthetic polynucleotide
agttgataacctggccatccgtgtgaatcggaatcccaagcaacgagg

SEQ ID NO: 1891 - DNA, 48 bp, Artificial Sequence
  Synthetic polynucleotide
ggataagggatgggtcactatcgtgaggcgcctccgtgtgcgctattg

SEQ ID NO: 1892 - DNA, 32 bp, Artificial Sequence
  Synthetic polynucleotide
ttttttttctgaaacatgggtgcgtttttttt

SEQ ID NO: 1893 - DNA, 48 bp, Artificial Sequence; identical to SEQ ID NO: 82
  Synthetic polynucleotide

SEQ ID NO: 1894 - DNA, 32 bp, Artificial Sequence; identical to SEQ ID NO: 83
  Synthetic polynucleotide

SEQ ID NO: 1895 - DNA, 48 bp, Artificial Sequence; identical to SEQ ID NO: 84
  Synthetic polynucleotide

SEQ ID NO: 1896 - DNA, 32 bp, Artificial Sequence; identical to SEQ ID NO: 6
  Synthetic polynucleotide

SEQ ID NO: 1897 - DNA, 48 bp, Artificial Sequence
  Synthetic polynucleotide
ttcatgtcgccttttcgaacggtgacacacttgtgttcattcagagta

SEQ ID NO: 1898 - DNA, 32 bp, Artificial Sequence
  Synthetic polynucleotide
gcggaaatatggccgcttcggtgcgcagcggg

SEQ ID NO: 1899 - DNA, 48 bp, Artificial Sequence
  Synthetic polynucleotide
ccgcctgtaacgcttaatcagcccgggcttttgctaatacgctgagcg

SEQ ID NO: 1900 - DNA, 32 bp, Artificial Sequence; identical to SEQ ID NO: 11
  Synthetic polynucleotide

SEQ ID NO: 1901 - DNA, 32 bp, Artificial Sequence
  Synthetic polynucleotide
ccgggctaatgaagccgtgaccccagagactg

SEQ ID NO: 1902 - DNA, 32 bp, Artificial Sequence
  Synthetic polynucleotide
tctgatgcaccgggagccagccacttagctgt

SEQ ID NO: 1903 - DNA, 32 bp, Artificial Sequence; identical to SEQ ID NO: 348
  Synthetic polynucleotide

SEQ ID NO: 1904 - DNA, 32 bp, Artificial Sequence; identical to SEQ ID NO: 17
  Synthetic polynucleotide

SEQ ID NO: 1905 - DNA, 32 bp, Artificial Sequence; identical to SEQ ID NO: 18
  Synthetic polynucleotide

SEQ ID NO: 1906 - DNA, 32 bp, Artificial Sequence; identical to SEQ ID NO: 19
  Synthetic polynucleotide

SEQ ID NO: 1907 - DNA, 32 bp, Artificial Sequence; identical to SEQ ID NO: 20
  Synthetic polynucleotide

SEQ ID NO: 1908 - DNA, 32 bp, Artificial Sequence; identical to SEQ ID NO: 21
  Synthetic polynucleotide

SEQ ID NO: 1909 - DNA, 48 bp, Artificial Sequence
  Synthetic polynucleotide
gcgtaaagatctcgcattctggtgccaaaactgccgactcgttcaagc

SEQ ID NO: 1910 - DNA, 48 bp, Artificial Sequence
  Synthetic polynucleotide
actattatctggctataaaagatgtctgtcagcccaagcttagcataa

SEQ ID NO: 1911 - DNA, 48 bp, Artificial Sequence; identical to SEQ ID NO: 357
  Synthetic polynucleotide

SEQ ID NO: 1912 - DNA, 48 bp, Artificial Sequence
  Synthetic polynucleotide
gacaaacgcatatcctcggcccgccaaattaatagtcgattacgcttc

SEQ ID NO: 1913 - DNA, 16 bp, Artificial Sequence
  Synthetic polynucleotide
gcctaaaggtccttcc

SEQ ID NO: 1914 - DNA, 32 bp, Artificial Sequence
  Synthetic polynucleotide
acggtaatcgggggtgactccggcctccttgg

SEQ ID NO: 1915 - DNA, 48 bp, Artificial Sequence
  Synthetic polynucleotide
tatattagcttacccactcgcgtggcacgtctacgactcgtcgaacga

SEQ ID NO: 1916 - DNA, 32 bp, Artificial Sequence; identical to SEQ ID NO: 33
  Synthetic polynucleotide

SEQ ID NO: 1917 - DNA, 48 bp, Artificial Sequence
  Synthetic polynucleotide
tcactgggcgctatacaggaaactcgaggggctccctgtctgtcgagc

SEQ ID NO: 1918 - DNA, 32 bp, Artificial Sequence
  Synthetic polynucleotide
ccagcgaccacttctggagaaagatgcggtgg

SEQ ID NO: 1919 - DNA, 48 bp, Artificial Sequence
  Synthetic polynucleotide
cagtagttgtgattagcttgggggtgatatacctcactaaactccttc

SEQ ID NO: 1920 - DNA, 32 bp, Artificial Sequence; identical to SEQ ID NO: 38
  Synthetic polynucleotide

SEQ ID NO: 1921 - DNA, 32 bp, Artificial Sequence; identical to SEQ ID NO: 39
  Synthetic polynucleotide

SEQ ID NO: 1922 - DNA, 32 bp, Artificial Sequence
  Synthetic polynucleotide
tatgcgcccgatatccgttcaaactagggggc

SEQ ID NO: 1923 - DNA, 32 bp, Artificial Sequence
  Synthetic polynucleotide
ttctgaccaaagctcatgagaattgtaaacag

SEQ ID NO: 1924 - DNA, 32 bp, Artificial Sequence; identical to SEQ ID NO: 370
  Synthetic polynucleotide

SEQ ID NO: 1925 - DNA, 32 bp, Artificial Sequence; identical to SEQ ID NO: 45
  Synthetic polynucleotide

SEQ ID NO: 1926 - DNA, 32 bp, Artificial Sequence; identical to SEQ ID NO: 46
  Synthetic polynucleotide

SEQ ID NO: 1927 - DNA, 32 bp, Artificial Sequence; identical to SEQ ID NO: 47
  Synthetic polynucleotide

SEQ ID NO: 1928 - DNA, 32 bp, Artificial Sequence; identical to SEQ ID NO: 48
  Synthetic polynucleotide

SEQ ID NO: 1929 - DNA, 32 bp, Artificial Sequence; identical to SEQ ID NO: 49
  Synthetic polynucleotide

SEQ ID NO: 1930 - DNA, 16 bp, Artificial Sequence
  Synthetic polynucleotide
agcacgaggattatca

SEQ ID NO: 1931 - DNA, 48 bp, Artificial Sequence
  Synthetic polynucleotide
cgtgtacctcgaaataatcgttagtttctcgactgttccgaaacaggc

SEQ ID NO: 1932 - DNA, 48 bp, Artificial Sequence
  Synthetic polynucleotide
agcggtagcctcccacttaacctatgccttggtaactgattttctcct

SEQ ID NO: 1933 - DNA, 48 bp, Artificial Sequence; identical to SEQ ID NO: 244
  Synthetic polynucleotide

SEQ ID NO: 1934 - DNA, 32 bp, Artificial Sequence; identical to SEQ ID NO: 56
  Synthetic polynucleotide

SEQ ID NO: 1935 - DNA, 48 bp, Artificial Sequence; identical to SEQ ID NO: 251
  Synthetic polynucleotide

SEQ ID NO: 1936 - DNA, 32 bp, Artificial Sequence; identical to SEQ ID NO: 252
  Synthetic polynucleotide

SEQ ID NO: 1937 - DNA, 48 bp, Artificial Sequence; identical to SEQ ID NO: 253
  Synthetic polynucleotide

SEQ ID NO: 1938 - DNA, 32 bp, Artificial Sequence; identical to SEQ ID NO: 62
  Synthetic polynucleotide

SEQ ID NO: 1939 - DNA, 48 bp, Artificial Sequence
  Synthetic polynucleotide
actaattatccataactgtgcacgtcagggattctcaccggtggccgt

SEQ ID NO: 1940 - DNA, 32 bp, Artificial Sequence
  Synthetic polynucleotide
tgctacatcagtttctttgcactcctggggaa

SEQ ID NO: 1941 - DNA, 48 bp, Artificial Sequence
  Synthetic polynucleotide
actatacttacgcactggtttggagggattaggcaattgctaggttgc

SEQ ID NO: 1942 - DNA, 32 bp, Artificial Sequence; identical to SEQ ID NO: 67
  Synthetic polynucleotide

SEQ ID NO: 1943 - DNA, 32 bp, Artificial Sequence
  Synthetic polynucleotide
catgggcaataaagctgtagcctgaggcgcgc

SEQ ID NO: 1944 - DNA, 32 bp, Artificial Sequence; identical to SEQ ID NO: 936
  Synthetic polynucleotide

SEQ ID NO: 1945 - DNA, 32 bp, Artificial Sequence; identical to SEQ ID NO: 392
  Synthetic polynucleotide

SEQ ID NO: 1946 - DNA, 32 bp, Artificial Sequence; identical to SEQ ID NO: 73
  Synthetic polynucleotide

SEQ ID NO: 1947 - DNA, 32 bp, Artificial Sequence; identical to SEQ ID NO: 74
  Synthetic polynucleotide

SEQ ID NO: 1948 - DNA, 32 bp, Artificial Sequence; identical to SEQ ID NO: 75
  Synthetic polynucleotide

SEQ ID NO: 1949 - DNA, 32 bp, Artificial Sequence; identical to SEQ ID NO: 76
  Synthetic polynucleotide

SEQ ID NO: 1950 - DNA, 32 bp, Artificial Sequence; identical to SEQ ID NO: 77
  Synthetic polynucleotide

SEQ ID NO: 1951 - DNA, 48 bp, Artificial Sequence
  Synthetic polynucleotide
gaccagatctgctagaaaccaccaacatcctccttgacacctttcaat

SEQ ID NO: 1952 - DNA, 48 bp, Artificial Sequence
  Synthetic polynucleotide
ttttagtaaacacccaacagagctgaacttcccatggtcgttctactg

SEQ ID NO: 1953 - DNA, 48 bp, Artificial Sequence; identical to SEQ ID NO: 401
  Synthetic polynucleotide

SEQ ID NO: 1954 - DNA, 48 bp, Artificial Sequence; identical to SEQ ID NO: 946
  Synthetic polynucleotide

SEQ ID NO: 1955 - DNA, 16 bp, Artificial Sequence
  Synthetic polynucleotide
ttaagacggccggtgt

SEQ ID NO: 1956 - DNA, 32 bp, Artificial Sequence
  Synthetic polynucleotide
aaccacataaagtcgtccgcctccggtagtca

SEQ ID NO: 1957 - DNA, 48 bp, Artificial Sequence; identical to SEQ ID NO: 948
  Synthetic polynucleotide

SEQ ID NO: 1958 - DNA, 32 bp, Artificial Sequence
  Synthetic polynucleotide
taccggggtgaacagcacgtgcggcttctcct

SEQ ID NO: 1959 - DNA, 48 bp, Artificial Sequence
  Synthetic polynucleotide
gtatcgccttgtgtattatactcttgcgggggggtcgagcgctccact

SEQ ID NO: 1960 - DNA, 32 bp, Artificial Sequence
  Synthetic polynucleotide
gtagtggccggccatcgtggactagaaagcgc

SEQ ID NO: 1961 - DNA, 48 bp, Artificial Sequence
  Synthetic polynucleotide
cggcaatctgaatatcgctacctccgatacgcgaaccagaaccattta

SEQ ID NO: 1962 - DNA, 32 bp, Artificial Sequence; identical to SEQ ID NO: 410
  Synthetic polynucleotide

SEQ ID NO: 1963 - DNA, 32 bp, Artificial Sequence
  Synthetic polynucleotide
acatctcggaaaggtgtcccaagtgcaagtaa

SEQ ID NO: 1964 - DNA, 32 bp, Artificial Sequence
  Synthetic polynucleotide
aaaaggaattatgagatcatgtgggatcctaa

SEQ ID NO: 1965 - DNA, 32 bp, Artificial Sequence
  Synthetic polynucleotide
agtttctggtagacctcgtaggctagagcggt

SEQ ID NO: 1966 - DNA, 32 bp, Artificial Sequence; identical to SEQ ID NO: 414
  Synthetic polynucleotide

SEQ ID NO: 1967 - DNA, 32 bp, Artificial Sequence
  Synthetic polynucleotide
acgagagtgctggcataagcaagagaaaccta

SEQ ID NO: 1968 - DNA, 32 bp, Artificial Sequence
  Synthetic polynucleotide
acttggggactaagatcgttgcgaattttcgc

SEQ ID NO: 1969 - DNA, 32 bp, Artificial Sequence; identical to SEQ ID NO: 418
  Synthetic polynucleotide

SEQ ID NO: 1970 - DNA, 32 bp, Artificial Sequence; identical to SEQ ID NO: 416
  Synthetic polynucleotide

SEQ ID NO: 1971 - DNA, 32 bp, Artificial Sequence; identical to SEQ ID NO: 419
  Synthetic polynucleotide

SEQ ID NO: 1972 - DNA, 16 bp, Artificial Sequence
  Synthetic polynucleotide
cagcttgacgcaagac

SEQ ID NO: 1973 - DNA, 48 bp, Artificial Sequence
  Synthetic polynucleotide
gctaatcactgggcagggtcctaggttgcagaaacctaccccctaagc

SEQ ID NO: 1974 - DNA, 48 bp, Artificial Sequence; identical to SEQ ID NO: 965
  Synthetic polynucleotide

SEQ ID NO: 1975 - DNA, 48 bp, Artificial Sequence
  Synthetic polynucleotide
ggccttgacatgacattctcccacccgtccaacaccagcaggatgtcg

SEQ ID NO: 1976 - DNA, 32 bp, Artificial Sequence
  Synthetic polynucleotide
agcccacaacttgacagtagtacagtatcttt

SEQ ID NO: 1977 - DNA, 48 bp, Artificial Sequence; identical to SEQ ID NO: 425
  Synthetic polynucleotide

SEQ ID NO: 1978 - DNA, 32 bp, Artificial Sequence; identical to SEQ ID NO: 427
  Synthetic polynucleotide

SEQ ID NO: 1979 - DNA, 48 bp, Artificial Sequence; identical to SEQ ID NO: 426
  Synthetic polynucleotide

SEQ ID NO: 1980 - DNA, 32 bp, Artificial Sequence; identical to SEQ ID NO: 428
  Synthetic polynucleotide

SEQ ID NO: 1981 - DNA, 48 bp, Artificial Sequence
  Synthetic polynucleotide
cgcgcttaccaagtaacgtatgtacgacgcgatgcgagtgaacgggtg

SEQ ID NO: 1982 - DNA, 32 bp, Artificial Sequence
  Synthetic polynucleotide
gatgaatttcgttcggggccaggcgatctaag

SEQ ID NO: 1983 - DNA, 48 bp, Artificial Sequence; identical to SEQ ID NO: 974
  Synthetic polynucleotide

SEQ ID NO: 1984 - DNA, 32 bp, Artificial Sequence
  Synthetic polynucleotide
atagcatcgacactacgacctgcttttcgaca

SEQ ID NO: 1985 - DNA, 32 bp, Artificial Sequence
  Synthetic polynucleotide
cggactgcattctggacagtaactgcattaac

SEQ ID NO: 1986 - DNA, 32 bp, Artificial Sequence
  Synthetic polynucleotide
tacgtgctcccaacataagtgacgtcctcagc

SEQ ID NO: 1987 - DNA, 32 bp, Artificial Sequence; identical to SEQ ID NO: 436
  Synthetic polynucleotide

SEQ ID NO: 1988 - DNA, 32 bp, Artificial Sequence
  Synthetic polynucleotide
tgtataactggcaagagacaaggccgcttcag

SEQ ID NO: 1989 - DNA, 32 bp, Artificial Sequence
  Synthetic polynucleotide
aaaggatagccggaccgtattaatgccgcgcc

SEQ ID NO: 1990 - DNA, 32 bp, Artificial Sequence; identical to SEQ ID NO: 440
  Synthetic polynucleotide

SEQ ID NO: 1991 - DNA, 32 bp, Artificial Sequence; identical to SEQ ID NO: 438
  Synthetic polynucleotide

SEQ ID NO: 1992 - DNA, 32 bp, Artificial Sequence; identical to SEQ ID NO: 441
  Synthetic polynucleotide

SEQ ID NO: 1993 - DNA, 48 bp, Artificial Sequence
  Synthetic polynucleotide
gttccgcgcgaatagctcacaggcgaactacgtatgaattggtttaaa

SEQ ID NO: 1994 - DNA, 48 bp, Artificial Sequence
  Synthetic polynucleotide
cgctcctcgggaattaatacgacaggtggcaaaccacctccgatgtca

SEQ ID NO: 1995 - DNA, 48 bp, Artificial Sequence; identical to SEQ ID NO: 445
  Synthetic polynucleotide

SEQ ID NO: 1996 - DNA, 48 bp, Artificial Sequence
  Synthetic polynucleotide
tccatgggattcaccaagctcgtatacaccctgattctccatggcagc

SEQ ID NO: 1997 - DNA, 16 bp, Artificial Sequence
  Synthetic polynucleotide
gcttcggtacaggtct

SEQ ID NO: 1998 - DNA, 32 bp, Artificial Sequence
  Synthetic polynucleotide
gaactggtagatcaccattagtgtacccagca

SEQ ID NO: 1999 - DNA, 48 bp, Artificial Sequence
  Synthetic polynucleotide
gttcggctcccttgtggactcgggatacccggtcgtcgtgtaatgctg

SEQ ID NO: 2000 - DNA, 32 bp, Artificial Sequence
  Synthetic polynucleotide
ttccggggtaaatcaagctttataaattcccg

SEQ ID NO: 2001 - DNA, 48 bp, Artificial Sequence
  Synthetic polynucleotide
acgctctgttccaaactttagagcccggccgtaatctcggattcctta

SEQ ID NO: 2002 - DNA, 32 bp, Artificial Sequence
  Synthetic polynucleotide
aaaaccaggcgcaatctcatggcataaacgaa

SEQ ID NO: 2003 - DNA, 48 bp, Artificial Sequence
  Synthetic polynucleotide
acccaatcatacgagcgtggagggaagttattctactggcgttttcat

SEQ ID NO: 2004 - DNA, 32 bp, Artificial Sequence
  Synthetic polynucleotide
atatcagagagcacagtaattcggagcccggc

SEQ ID NO: 2005 - DNA, 32 bp, Artificial Sequence
  Synthetic polynucleotide
gtattatcgcgtcaattcatatggacacacca

SEQ ID NO: 2006 - DNA, 32 bp, Artificial Sequence
  Synthetic polynucleotide
gattacggcggcttaggggaattgagtacaag

SEQ ID NO: 2007 - DNA, 32 bp, Artificial Sequence
  Synthetic polynucleotide
tgacgaagaataccgtccatcagatggagctg

SEQ ID NO: 2008 - DNA, 32 bp, Artificial Sequence
  Synthetic polynucleotide
tcaggcttctccgtcaaaatgttggctgagat

SEQ ID NO: 2009 - DNA, 32 bp, Artificial Sequence
  Synthetic polynucleotide
tgattggtttagtgtatagcgagtaagagata

SEQ ID NO: 2010 - DNA, 32 bp, Artificial Sequence
  Synthetic polynucleotide
tgtgggaggatcattacaggatcaaagttgac

SEQ ID NO: 2011 - DNA, 32 bp, Artificial Sequence
  Synthetic polynucleotide
tagcagaataatttgcatccgaataaggtacg

SEQ ID NO: 2012 - DNA, 32 bp, Artificial Sequence
  Synthetic polynucleotide
caattactatttgtaccgaaaacaagggcata

SEQ ID NO: 2013 - DNA, 32 bp, Artificial Sequence
  Synthetic polynucleotide
cagtaacgaaaagcgaacgagccaccacctag

SEQ ID NO: 2014 - DNA, 16 bp, Artificial Sequence
  Synthetic polynucleotide
cacctcctgttagggt

SEQ ID NO: 2015 - DNA, 48 bp, Artificial Sequence
  Synthetic polynucleotide
gacacccgggatgggttgttcatcggtcaccccagttttcgcttgagg

SEQ ID NO: 2016 - DNA, 48 bp, Artificial Sequence
  Synthetic polynucleotide
aatagtccaagaaatgcatgataaaagttgtgccgcactggaatctga

SEQ ID NO: 2017 - DNA, 48 bp, Artificial Sequence
  Synthetic polynucleotide
agatgcaccggttctcgagacactcatttactgctcggtagaccatgt

SEQ ID NO: 2018 - DNA, 32 bp, Artificial Sequence
  Synthetic polynucleotide
ctccagtattgccattttctaattaatacttt

SEQ ID NO: 2019 - DNA, 48 bp, Artificial Sequence
  Synthetic polynucleotide
taatataatgtccgcggatcagcgaattcgacacaatggtatcttttg

SEQ ID NO: 2020 - DNA, 32 bp, Artificial Sequence
  Synthetic polynucleotide
aagcgcacgtaaaccgcttgcctgggccaata

SEQ ID NO: 2021 - DNA, 48 bp, Artificial Sequence
  Synthetic polynucleotide
ctttgtggtccactatatataggtctgacacccagctcccaggtaagt

SEQ ID NO: 2022 - DNA, 32 bp, Artificial Sequence
  Synthetic polynucleotide
gcggagagaaatggctaatggtcgacaatatg

SEQ ID NO: 2023 - DNA, 48 bp, Artificial Sequence
  Synthetic polynucleotide
tattaagttttcgccgtgagcgatcaatgaccccagtaatagcctgaa

SEQ ID NO: 2024 - DNA, 32 bp, Artificial Sequence
  Synthetic polynucleotide
caccctgcatcgacggcttctacctcttaatg

SEQ ID NO: 2025 - DNA, 48 bp, Artificial Sequence
  Synthetic polynucleotide
tataattcatcctgtgcatggaagcagagttcccatcggcaaaattga

SEQ ID NO: 2026 - DNA, 32 bp, Artificial Sequence
  Synthetic polynucleotide
gttaccgctataattaagaacattcgggttcg

SEQ ID NO: 2027 - DNA, 32 bp, Artificial Sequence
  Synthetic polynucleotide
acgtggtctatgtgatcgcctaggctaacctc

SEQ ID NO: 2028 - DNA, 32 bp, Artificial Sequence
  Synthetic polynucleotide
atgactccaggagagggtgagctcctacgtgg

SEQ ID NO: 2029 - DNA, 32 bp, Artificial Sequence; identical to SEQ ID NO: 1020
  Synthetic polynucleotide

SEQ ID NO: 2030 - DNA, 32 bp, Artificial Sequence
  Synthetic polynucleotide
attcagaatcgagaccttgctcttggacgtct

SEQ ID NO: 2031 - DNA, 32 bp, Artificial Sequence
  Synthetic polynucleotide
cattctatagcccgcggttactaggcgccttg

SEQ ID NO: 2032 - DNA, 32 bp, Artificial Sequence
  Synthetic polynucleotide
ctcctacgctcaatagtgaacccttactatcg

SEQ ID NO: 2033 - DNA, 32 bp, Artificial Sequence
  Synthetic polynucleotide
cgacaggataggtcaaaataaacgatacttaa

SEQ ID NO: 2034 - DNA, 32 bp, Artificial Sequence
  Synthetic polynucleotide
agctctagaggggaaccgtagacttcacataa

SEQ ID NO: 2035 - DNA, 48 bp, Artificial Sequence; identical to SEQ ID NO: 1025
  Synthetic polynucleotide

SEQ ID NO: 2036 - DNA, 48 bp, Artificial Sequence; identical to SEQ ID NO: 1026
  Synthetic polynucleotide

SEQ ID NO: 2037 - DNA, 48 bp, Artificial Sequence
  Synthetic polynucleotide
gggcgtaaacaaaaaacttgcctatcgtgccctcatacagcattgtct

SEQ ID NO: 2038 - DNA, 48 bp, Artificial Sequence
  Synthetic polynucleotide
accacctatgttcttatgctgttaacatagatcgtcgggcgaccttcg

SEQ ID NO: 2039 - DNA, 16 bp, Artificial Sequence
  Synthetic polynucleotide
taaggtggggccgacc

SEQ ID NO: 2040 - DNA, 32 bp, Artificial Sequence
  Synthetic polynucleotide
accgaccaaggcgctatagggtatactcgtaa

SEQ ID NO: 2041 - DNA, 48 bp, Artificial Sequence
  Synthetic polynucleotide
gcgatatctgaatgcgtaatacgaaacgacaaaaaataccttcgccgg

SEQ ID NO: 2042 - DNA, 32 bp, Artificial Sequence
  Synthetic polynucleotide
tccgtccgttggagcccacgaaccaacgcatc

SEQ ID NO: 2043 - DNA, 48 bp, Artificial Sequence
  Synthetic polynucleotide
cttagtgctgtagtttaccattaccggaggcgcattaggtctattata

SEQ ID NO: 2044 - DNA, 32 bp, Artificial Sequence
  Synthetic polynucleotide
atgggacgccactacgtatcgttctataaaat

SEQ ID NO: 2045 - DNA, 48 bp, Artificial Sequence; identical to SEQ ID NO: 1037
  Synthetic polynucleotide

SEQ ID NO: 2046 - DNA, 32 bp, Artificial Sequence
  Synthetic polynucleotide
ggcacagcttggcgatatatcatctacaatgt

SEQ ID NO: 2047 - DNA, 32 bp, Artificial Sequence
  Synthetic polynucleotide
gtctgacccttcacattaatatggggattacc

SEQ ID NO: 2048 - DNA, 32 bp, Artificial Sequence
  Synthetic polynucleotide
cttcaataagttgtaggcatcagctggcaggt

SEQ ID NO: 2049 - DNA, 32 bp, Artificial Sequence; identical to SEQ ID NO: 1040
  Synthetic polynucleotide

SEQ ID NO: 2050 - DNA, 32 bp, Artificial Sequence
  Synthetic polynucleotide
atgtgtaatggtgggcggacgatatctgcgcc

SEQ ID NO: 2051 - DNA, 32 bp, Artificial Sequence
  Synthetic polynucleotide
agcgccacgtccccaattgtcgggacctgtca

SEQ ID NO: 2052 - DNA, 32 bp, Artificial Sequence
  Synthetic polynucleotide
ttggagtgatgaacaacctgggtcctgctgcc

SEQ ID NO: 2053 - DNA, 32 bp, Artificial Sequence
  Synthetic polynucleotide
gccctttggggttcacgcccgcgcataaccta

SEQ ID NO: 2054 - DNA, 32 bp, Artificial Sequence
  Synthetic polynucleotide
agtaatgtctagtgccgtatgtgaaagagtca

SEQ ID NO: 2055 - DNA, 32 bp, Artificial Sequence
  Synthetic polynucleotide
agcgtaaagtcttgacgtattccatccagctg

SEQ ID NO: 2056 - DNA, 16 bp, Artificial Sequence
  Synthetic polynucleotide
acggtatggaaagaag

SEQ ID NO: 2057 - DNA, 48 bp, Artificial Sequence
  Synthetic polynucleotide
cgaaggggctcgagtctacagcagagctacgcgtcccacgtctttaaa

SEQ ID NO: 2058 - DNA, 48 bp, Artificial Sequence
  Synthetic polynucleotide
tgtcccgtgttagggctcgcatctcgtggaatccattcagttcacagg

SEQ ID NO: 2059 - DNA, 48 bp, Artificial Sequence
  Synthetic polynucleotide
cccttagccgtacaaagcgttactgacccgctgcaggtaaatgcaaaa

SEQ ID NO: 2060 - DNA, 32 bp, Artificial Sequence
  Synthetic polynucleotide
ctatgtctttctgaggaggagcagtttgggtc

SEQ ID NO: 2061 - DNA, 48 bp, Artificial Sequence
  Synthetic polynucleotide
tacggcaccgaggcctaatccgatgaccctaagagtccccgaagaata

SEQ ID NO: 2062 - DNA, 32 bp, Artificial Sequence
  Synthetic polynucleotide
ggatattctccgccggcaagtaagcagggcgt

SEQ ID NO: 2063 - DNA, 48 bp, Artificial Sequence
  Synthetic polynucleotide
aaaagcagtcaaccggcgacgagtaacggcatcttccgactttttata

SEQ ID NO: 2064 - DNA, 32 bp, Artificial Sequence
  Synthetic polynucleotide
actgctgggtgggcgcgagaccaggcgtccgg

SEQ ID NO: 2065 - DNA, 48 bp, Artificial Sequence
  Synthetic polynucleotide
cactgtgtggacgtttgagcaatagaaattgatatgagttaccctgca

SEQ ID NO: 2066 - DNA, 32 bp, Artificial Sequence
  Synthetic polynucleotide
atcggctcaagacgtagaatgagcgacgcacc

SEQ ID NO: 2067 - DNA, 48 bp, Artificial Sequence
  Synthetic polynucleotide
tgataattaacactccatgcggagaggtaggcagcgtcgcttaaagtg

SEQ ID NO: 2068 - DNA, 32 bp, Artificial Sequence
  Synthetic polynucleotide
tgtccaagacaacatgactacagttgaccggg

SEQ ID NO: 2069 - DNA, 32 bp, Artificial Sequence
  Synthetic polynucleotide
ggtgcaaaaagcgcaacggcgccgattgatca

SEQ ID NO: 2070 - DNA, 32 bp, Artificial Sequence
  Synthetic polynucleotide
atggttaagtataggtccttgttacgatggca

SEQ ID NO: 2071 - DNA, 32 bp, Artificial Sequence
  Synthetic polynucleotide
gcaatattcggaccttccaccgggtctgttcc

SEQ ID NO: 2072 - DNA, 32 bp, Artificial Sequence
  Synthetic polynucleotide
attgagcaggaatactcagccttcaccgcggg

SEQ ID NO: 2073 - DNA, 32 bp, Artificial Sequence
  Synthetic polynucleotide
tctctatcgtacacatctctggctttaccaag

SEQ ID NO: 2074 - DNA, 32 bp, Artificial Sequence
  Synthetic polynucleotide
ccactaacgggacagtcggaacatgcacgatg

SEQ ID NO: 2075 - DNA, 32 bp, Artificial Sequence
  Synthetic polynucleotide
tccgggatgggtgccaccgcaacctttacgtg

SEQ ID NO: 2076 - DNA, 32 bp, Artificial Sequence
  Synthetic polynucleotide
tttagggaatacaagattcagcagccttactc

SEQ ID NO: 2077 - DNA, 48 bp, Artificial Sequence
  Synthetic polynucleotide
agcaatatcacggacaggaacaacgggtgtcagtccaagtaagggcaa

SEQ ID NO: 2078 - DNA, 48 bp, Artificial Sequence
  Synthetic polynucleotide
tcgtatttgatgcccgtgtgtatgctcacttttctggcgccggcttag

SEQ ID NO: 2079 - DNA, 48 bp, Artificial Sequence
  Synthetic polynucleotide
ccgtcacgcattgtggttcgccgcgtcgttttctcagtttaagattca

SEQ ID NO: 2080 - DNA, 48 bp, Artificial Sequence
  Synthetic polynucleotide
acaggacgatgttctcacctcttcaggtcttaattttggcggaacggg

SEQ ID NO: 2081 - DNA, 16 bp, Artificial Sequence
  Synthetic polynucleotide
aagcatcgcgtccttg

SEQ ID NO: 2082 - DNA, 32 bp, Artificial Sequence
  Synthetic polynucleotide
gcatccgctcgcatggttaagatgtgtggcaa

SEQ ID NO: 2083 - DNA, 48 bp, Artificial Sequence
  Synthetic polynucleotide
tacaatatagttatatcctcatgtaacggtcgtatccgcctatctcgc

SEQ ID NO: 2084 - DNA, 32 bp, Artificial Sequence
  Synthetic polynucleotide
agagttctaccagccaagagagtcgcagccct

SEQ ID NO: 2085 - DNA, 48 bp, Artificial Sequence
  Synthetic polynucleotide
tcatcgtaggacatcacatctctgcctcgacgtacgcgggcaatggag

SEQ ID NO: 2086 - DNA, 32 bp, Artificial Sequence
  Synthetic polynucleotide
gtgggcgcaaaccgttaccacacttgtcccga

SEQ ID NO: 2087 - DNA, 48 bp, Artificial Sequence
  Synthetic polynucleotide
ttcaacttttaaacagttgaaggtttgaaccagtagagtcgtagacga

SEQ ID NO: 2088 - DNA, 32 bp, Artificial Sequence
  Synthetic polynucleotide
ttccttgattcccaggttattgagacctatct

SEQ ID NO: 2089 - DNA, 32 bp, Artificial Sequence
  Synthetic polynucleotide
tcgtgcgaatgtactcgttcacaagctggcta

SEQ ID NO: 2090 - DNA, 32 bp, Artificial Sequence
  Synthetic polynucleotide
tagtacagtgggagtgatcacgctctacagca

SEQ ID NO: 2091 - DNA, 32 bp, Artificial Sequence
  Synthetic polynucleotide
ccgtgatgagacttcgtgcgttcgacgcctgc

SEQ ID NO: 2092 - DNA, 32 bp, Artificial Sequence
  Synthetic polynucleotide
ttccgtggccccgcaaccgcatcgctgagggg

SEQ ID NO: 2093 - DNA, 32 bp, Artificial Sequence
  Synthetic polynucleotide
gaggggatagcatacccagcacaaaccctcgc

SEQ ID NO: 2094 - DNA, 32 bp, Artificial Sequence
  Synthetic polynucleotide
gggtgatcggccgttagtcgtaatgtgctgtg

SEQ ID NO: 2095 - DNA, 32 bp, Artificial Sequence
  Synthetic polynucleotide
ttctatcgatctccttcgcaacaaaatgcaaa

SEQ ID NO: 2096 - DNA, 32 bp, Artificial Sequence
  Synthetic polynucleotide
accatgttgaaattgtgctgccgacacgaggc

SEQ ID NO: 2097 - DNA, 32 bp, Artificial Sequence
  Synthetic polynucleotide
acacggcgtcagcgatcgcatctacctagcaa

SEQ ID NO: 2098 - DNA, 16 bp, Artificial Sequence
  Synthetic polynucleotide
taagacaagtagaaca

SEQ ID NO: 2099 - DNA, 48 bp, Artificial Sequence
  Synthetic polynucleotide
ttgtgttgggtgtagtggattcatttaactaccgatgttattacctaa

SEQ ID NO: 2100 - DNA, 48 bp, Artificial Sequence
  Synthetic polynucleotide
taccatgaggagcagggattgactaatacatttatgaatccagacacg

SEQ ID NO: 2101 - DNA, 48 bp, Artificial Sequence
  Synthetic polynucleotide
aggtacactccggggagtagtctgtagggtgatatacccggcaagctc

SEQ ID NO: 2102 - DNA, 32 bp, Artificial Sequence
  Synthetic polynucleotide
gtcaagtggtatagcccgcagcactacgctcc

SEQ ID NO: 2103 - DNA, 16 bp, Artificial Sequence
  Synthetic polynucleotide
gtatgatttttttttt

SEQ ID NO: 2104 - DNA, 48 bp, Artificial Sequence
  Synthetic polynucleotide
ctatcttcataggacacaacagttaaccgtgactcgtgcttcgagaaa

SEQ ID NO: 2105 - DNA, 48 bp, Artificial Sequence
  Synthetic polynucleotide
caccgttctccggtttagcgaatttatgctctggtacacgccaaggca

SEQ ID NO: 2106 - DNA, 48 bp, Artificial Sequence
  Synthetic polynucleotide
gggctgattactctgaatgaacacaagtgtgtctaccgctatattaag

SEQ ID NO: 2107 - DNA, 48 bp, Artificial Sequence
  Synthetic polynucleotide
ttttttttcgctcagcgtattagcaaaagcccgcggaacctgtttcac

SEQ ID NO: 2108 - DNA, 16 bp, Artificial Sequence
  Synthetic polynucleotide
ggggtcactttttttt

SEQ ID NO: 2109 - DNA, 48 bp, Artificial Sequence
  Synthetic polynucleotide
gagggaacgtgcgttgagttcgtacagtctctggcgcatatgagcttt

SEQ ID NO: 2110 - DNA, 48 bp, Artificial Sequence
  Synthetic polynucleotide
ccaggtcatactcgatcactgagtcctagctaagctgttctccccgtc

SEQ ID NO: 2111 - DNA, 48 bp, Artificial Sequence
  Synthetic polynucleotide
ttcttaaacccgctgcgcaccgaaccattatatcatccggttacttcg

SEQ ID NO: 2112 - DNA, 48 bp, Artificial Sequence
  Synthetic polynucleotide
ttttttttgttccggttcagaaactgcgatcacctatcttacgcttac

SEQ ID NO: 2113 - DNA, 16 bp, Artificial Sequence
  Synthetic polynucleotide
gagtcggctttttttt

SEQ ID NO: 2114 - DNA, 48 bp, Artificial Sequence
  Synthetic polynucleotide
agcttgggacagctaagtggctgggcttgaacattaccgttgggtaag

SEQ ID NO: 2115 - DNA, 48 bp, Artificial Sequence
  Synthetic polynucleotide
ctcgacggttccagctccatatccttatgctaaacagtccgtatagcg

SEQ ID NO: 2116 - DNA, 48 bp, Artificial Sequence
  Synthetic polynucleotide
atcgactagtgggacgtatgattggcgcaggggtcgctggctaatcac

SEQ ID NO: 2117 - DNA, 48 bp, Artificial Sequence
  Synthetic polynucleotide
ttttttttcaaccaaaagatgttcgaagcgtatcacattagaatatgg

SEQ ID NO: 2118 - DNA, 48 bp, Artificial Sequence
  Synthetic polynucleotide
ctttaggcttttttttttttttttagttttggcaccagaatgcgagat

SEQ ID NO: 2119 - DNA, 32 bp, Artificial Sequence
  Synthetic polynucleotide
cacgcgagggaaggactggtggtttctagcag

SEQ ID NO: 2120 - DNA, 48 bp, Artificial Sequence
  Synthetic polynucleotide
cgagtcgtagacgtgcctttacgcctgacagacatcttttatagccag

SEQ ID NO: 2121 - DNA, 32 bp, Artificial Sequence
  Synthetic polynucleotide
agtttccttcgttcgaagctctgttgggtgtt

SEQ ID NO: 2122 - DNA, 48 bp, Artificial Sequence
  Synthetic polynucleotide
gacagggagcccctcgataatagttcagtcgtcgcacggcggggtcgt

SEQ ID NO: 2123 - DNA, 32 bp, Artificial Sequence
  Synthetic polynucleotide
cccccaaggctcgacatagtttgatcctatga

SEQ ID NO: 2124 - DNA, 48 bp, Artificial Sequence
  Synthetic polynucleotide
ttagtgaggtatatcaccagccgcttaatttggcgggccgaggatatg

SEQ ID NO: 2125 - DNA, 32 bp, Artificial Sequence
  Synthetic polynucleotide
cttacatcgaaggagtggaatgcacgatcgcc

SEQ ID NO: 2126 - DNA, 32 bp, Artificial Sequence
  Synthetic polynucleotide
ttttttttgatgtccgcgtttgtctttttttt

SEQ ID NO: 2127 - DNA, 48 bp, Artificial Sequence
  Synthetic polynucleotide
gccggagtttttttttttttttttggcttcattagcccggctcccggt

SEQ ID NO: 2128 - DNA, 32 bp, Artificial Sequence
  Synthetic polynucleotide
aattctcaccaaggagtgcccatggtgacacg

SEQ ID NO: 2129 - DNA, 48 bp, Artificial Sequence
  Synthetic polynucleotide
ccaagtcactgtttacgcatcagatcgcgatcacactgacaccctttt

SEQ ID NO: 2130 - DNA, 32 bp, Artificial Sequence
  Synthetic polynucleotide
gtcgcataaacctcgtgacgaggtgccgatct

SEQ ID NO: 2131 - DNA, 48 bp, Artificial Sequence
  Synthetic polynucleotide
tctttctcatcatggtggcatcacctagaaatcagagccgaggtcagg

SEQ ID NO: 2132 - DNA, 32 bp, Artificial Sequence
  Synthetic polynucleotide
gctatgctccaccgcataactaagtggggcac

SEQ ID NO: 2133 - DNA, 48 bp, Artificial Sequence
  Synthetic polynucleotide
tggagttacgcagggttagctccgggggatgaatccttccaacatctc

SEQ ID NO: 2134 - DNA, 32 bp, Artificial Sequence
  Synthetic polynucleotide
gttatttcgtttccttggtacacctcacttgc

SEQ ID NO: 2135 - DNA, 32 bp, Artificial Sequence
  Synthetic polynucleotide
ttttttttttctggtcaaagactgtttttttt

SEQ ID NO: 2136 - DNA, 48 bp, Artificial Sequence
  Synthetic polynucleotide
gtttgaacttttttttttttttttgagccacttaacctggccatccct

SEQ ID NO: 2137 - DNA, 32 bp, Artificial Sequence
  Synthetic polynucleotide
cggaacaggccccctagggcactcatcgggtt

SEQ ID NO: 2138 - DNA, 48 bp, Artificial Sequence
  Synthetic polynucleotide
gaacttgagcctgtttaagtaaacttgagactacccgagcgagatgcg

SEQ ID NO: 2139 - DNA, 32 bp, Artificial Sequence
  Synthetic polynucleotide
atcagttagcgtatccagtacgacacaacata

SEQ ID NO: 2140 - DNA, 48 bp, Artificial Sequence
  Synthetic polynucleotide
tgacgatcaggagaaagatactttgaaaaggcgacatgaagcggccat

SEQ ID NO: 2141 - DNA, 32 bp, Artificial Sequence
  Synthetic polynucleotide
cgagggtttatcccaataattagtagaaactg

SEQ ID NO: 2142 - DNA, 48 bp, Artificial Sequence
  Synthetic polynucleotide
gtattactcttgcctcatttccgctaagcgttacaggcggcccgcaac

SEQ ID NO: 2143 - DNA, 32 bp, Artificial Sequence
  Synthetic polynucleotide
aggtggccaggtagagagtatagtaaattgtg

SEQ ID NO: 2144 - DNA, 32 bp, Artificial Sequence
  Synthetic polynucleotide
ttttttttcccgagccaacagcattttttttt

SEQ ID NO: 2145 - DNA, 32 bp, Artificial Sequence
  Synthetic polynucleotide
gaggcggctttttttttttttttttgataatc

SEQ ID NO: 2146 - DNA, 32 bp, Artificial Sequence
  Synthetic polynucleotide
cttgacgagtataacctcaagctgtctgcaac

SEQ ID NO: 2147 - DNA, 32 bp, Artificial Sequence
  Synthetic polynucleotide
tcccacgtaaagcaggctaacgattatttcga

SEQ ID NO: 2148 - DNA, 32 bp, Artificial Sequence
  Synthetic polynucleotide
tcagacgctcgggcactgattagcccgccgca

SEQ ID NO: 2149 - DNA, 32 bp, Artificial Sequence
  Synthetic polynucleotide
cgtgcacaaccatacctaggttaagtgggagg

SEQ ID NO: 2150 - DNA, 32 bp, Artificial Sequence
  Synthetic polynucleotide
cggtgagaatccctgaactacgctttggacgg

SEQ ID NO: 2151 - DNA, 32 bp, Artificial Sequence
  Synthetic polynucleotide
tccaaaccacggccacgaccatagatcagcta

SEQ ID NO: 2152 - DNA, 32 bp, Artificial Sequence
  Synthetic polynucleotide
gcaattgcctaatccctcaaggcctgtcaagt

SEQ ID NO: 2153 - DNA, 32 bp, Artificial Sequence
  Synthetic polynucleotide
ttttttttgcaacctacctctccctttttttt

SEQ ID NO: 2154 - DNA, 32 bp, Artificial Sequence
  Synthetic polynucleotide
caggctacttttttttttttttttggatatcg

SEQ ID NO: 2155 - DNA, 32 bp, Artificial Sequence
  Synthetic polynucleotide
aatgcacagcgcgcctttccttttaggtctac

SEQ ID NO: 2156 - DNA, 32 bp, Artificial Sequence
  Synthetic polynucleotide
tatggttttcacgtggggtcagaactgctcta

SEQ ID NO: 2157 - DNA, 32 bp, Artificial Sequence
  Synthetic polynucleotide
cacttgaggccctcagtggatatcatgccagc

SEQ ID NO: 2158 - DNA, 32 bp, Artificial Sequence
  Synthetic polynucleotide
ctaatgaaactgttagcataggtattcataac

SEQ ID NO: 2159 - DNA, 32 bp, Artificial Sequence
  Synthetic polynucleotide
gagtgcaattccgcccccccaagtgctacatg

SEQ ID NO: 2160 - DNA, 32 bp, Artificial Sequence
  Synthetic polynucleotide
ctcggcccttccccagagattgtagctgtgac

SEQ ID NO: 2161 - DNA, 32 bp, Artificial Sequence
  Synthetic polynucleotide
cgaatcaagcccagcgcgtcgtctagcacgca

SEQ ID NO: 2162 - DNA, 32 bp, Artificial Sequence
  Synthetic polynucleotide
tttttttttatgtgatgtccaacatttttttt

SEQ ID NO: 2163 - DNA, 32 bp, Artificial Sequence
  Synthetic polynucleotide
gtgtcaagttttttttttttttttcacccccg

SEQ ID NO: 2164 - DNA, 32 bp, Artificial Sequence
  Synthetic polynucleotide
atatcaagattgaaagatgtggttccattacg

SEQ ID NO: 2165 - DNA, 32 bp, Artificial Sequence
  Synthetic polynucleotide
cgaccatggtccctcactaatatactatgtag

SEQ ID NO: 2166 - DNA, 32 bp, Artificial Sequence
  Synthetic polynucleotide
aatgattacagtagaaccccggtaatacacaa

SEQ ID NO: 2167 - DNA, 32 bp, Artificial Sequence
  Synthetic polynucleotide
ggcggtacggagcactcccagtgacagaagtg

SEQ ID NO: 2168 - DNA, 32 bp, Artificial Sequence
  Synthetic polynucleotide
actgtacgcaagaactgccactacgatattca

SEQ ID NO: 2169 - DNA, 32 bp, Artificial Sequence
  Synthetic polynucleotide
gcggccatggttggttaactactgacgcttag

SEQ ID NO: 2170 - DNA, 32 bp, Artificial Sequence
  Synthetic polynucleotide
catatatttaagccaccctactctcacctttc

SEQ ID NO: 2171 - DNA, 32 bp, Artificial Sequence
  Synthetic polynucleotide
ttttttttgaccaagtgatagctgtttttttt

SEQ ID NO: 2172 - DNA, 32 bp, Artificial Sequence
  Synthetic polynucleotide
cgtcttaattttttttttttttttgaggatgt

SEQ ID NO: 2173 - DNA, 32 bp, Artificial Sequence
  Synthetic polynucleotide
actttctgacaccggcgcctgtgagctattcg

SEQ ID NO: 2174 - DNA, 32 bp, Artificial Sequence
  Synthetic polynucleotide
tttttgtcgggtatagatctggtcggaagttc

SEQ ID NO: 2175 - DNA, 32 bp, Artificial Sequence
  Synthetic polynucleotide
agagtatacaaatctgtgtcgtattaattccc

SEQ ID NO: 2176 - DNA, 32 bp, Artificial Sequence
  Synthetic polynucleotide
gctcgacccccccgcatactaaaagctgtatt

SEQ ID NO: 2177 - DNA, 32 bp, Artificial Sequence
  Synthetic polynucleotide
gaggtagcagtggagctcacagtgaatgggta

SEQ ID NO: 2178 - DNA, 32 bp, Artificial Sequence
  Synthetic polynucleotide
tctggttcgcgtatcgtcatacgacaaacatt

SEQ ID NO: 2179 - DNA, 32 bp, Artificial Sequence
  Synthetic polynucleotide
acttgggataaatggttacgagcttggtgaat

SEQ ID NO: 2180 - DNA, 32 bp, Artificial Sequence
  Synthetic polynucleotide
ttttttttttacttgcaataaggatttttttt

SEQ ID NO: 2181 - DNA, 32 bp, Artificial Sequence
  Synthetic polynucleotide
ggaggcggttttttttttttttttagctttat

SEQ ID NO: 2182 - DNA, 32 bp, Artificial Sequence
  Synthetic polynucleotide
agcctacgtgactaccgcagtccgatgttggg

SEQ ID NO: 2183 - DNA, 32 bp, Artificial Sequence
  Synthetic polynucleotide
ccgcacgtaccgctctgtgcagctatccgaat

SEQ ID NO: 2184 - DNA, 32 bp, Artificial Sequence
  Synthetic polynucleotide
tcttgcttaggagaagtttcaacttcttgcca

SEQ ID NO: 2185 - DNA, 32 bp, Artificial Sequence
  Synthetic polynucleotide
tagtccactaggtttccgcccactctatgaac

SEQ ID NO: 2186 - DNA, 32 bp, Artificial Sequence
  Synthetic polynucleotide
ctcgttcggcgctttctatcctttggtccggg

SEQ ID NO: 2187 - DNA, 32 bp, Artificial Sequence
  Synthetic polynucleotide
ttggctgaaggacgatcagcccattacccaca

SEQ ID NO: 2188 - DNA, 32 bp, Artificial Sequence
  Synthetic polynucleotide
gcgttaaacccactgtatagaatataggtcac

SEQ ID NO: 2189 - DNA, 32 bp, Artificial Sequence
  Synthetic polynucleotide
ttttttttggtctaaaacatgtaatttttttt

SEQ ID NO: 2190 - DNA, 32 bp, Artificial Sequence
  Synthetic polynucleotide
ccacatgatttttttttttttttttgccgagg

SEQ ID NO: 2191 - DNA, 32 bp, Artificial Sequence
  Synthetic polynucleotide
ggtaggttttaggatcccatgaaagtccggtc

SEQ ID NO: 2192 - DNA, 32 bp, Artificial Sequence
  Synthetic polynucleotide
gtaaacgagcttagggagctatggttgcttta

SEQ ID NO: 2193 - DNA, 32 bp, Artificial Sequence
  Synthetic polynucleotide
tcgtacagtccgtgcaacgactcttcaccgaa

SEQ ID NO: 2194 - DNA, 32 bp, Artificial Sequence
  Synthetic polynucleotide
tcgcaacgggactcatgtgggtaagttatgga

SEQ ID NO: 2195 - DNA, 32 bp, Artificial Sequence
  Synthetic polynucleotide
tgctggtggcgaaaattaagcgcgccgaacga

SEQ ID NO: 2196 - DNA, 32 bp, Artificial Sequence
  Synthetic polynucleotide
cggcatgccgacatccatgtagcaagtgcgta

SEQ ID NO: 2197 - DNA, 32 bp, Artificial Sequence
  Synthetic polynucleotide
tgtactacggtgctacgcgccagagtagtgtc

SEQ ID NO: 2198 - DNA, 32 bp, Artificial Sequence
  Synthetic polynucleotide
ttttttttaaagataccctacaattttttttt

SEQ ID NO: 2199 - DNA, 32 bp, Artificial Sequence
  Synthetic polynucleotide
aacggcgattttttttttttttttgtcttgcg

SEQ ID NO: 2200 - DNA, 32 bp, Artificial Sequence
  Synthetic polynucleotide
cgtacgcacgcgagcaaggaggtggggtgacc

SEQ ID NO: 2201 - DNA, 32 bp, Artificial Sequence
  Synthetic polynucleotide
agaaccggataaaagcctaggaccctgcccag

SEQ ID NO: 2202 - DNA, 32 bp, Artificial Sequence
  Synthetic polynucleotide
ccagtcccactctagccgggtgtccacaactt

SEQ ID NO: 2203 - DNA, 32 bp, Artificial Sequence
  Synthetic polynucleotide
tacatacgcatctgatggaacttgtaaccctt

SEQ ID NO: 2204 - DNA, 32 bp, Artificial Sequence
  Synthetic polynucleotide
cactcgcatcgcgtcgggactattagtaaatg

SEQ ID NO: 2205 - DNA, 32 bp, Artificial Sequence
  Synthetic polynucleotide
acttacgtcacccgttgtgggagaatgtcatg

SEQ ID NO: 2206 - DNA, 32 bp, Artificial Sequence
  Synthetic polynucleotide
aaagcttcctacttcagtgcatctaatggcaa

SEQ ID NO: 2207 - DNA, 32 bp, Artificial Sequence
  Synthetic polynucleotide
ttttttttggctagaatgtgggcttttttttt

SEQ ID NO: 2208 - DNA, 32 bp, Artificial Sequence
  Synthetic polynucleotide
agttactgtttttttttttttttttctcataa

SEQ ID NO: 2209 - DNA, 32 bp, Artificial Sequence
  Synthetic polynucleotide
acggggttgttaatgcccgtaatcacggtatt

SEQ ID NO: 2210 - DNA, 32 bp, Artificial Sequence
  Synthetic polynucleotide
tgcttatctacgatttcagaaactatgtaccg

SEQ ID NO: 2211 - DNA, 32 bp, Artificial Sequence
  Synthetic polynucleotide
cggggaggggtccttcaagcctgatacactaa

SEQ ID NO: 2212 - DNA, 32 bp, Artificial Sequence
  Synthetic polynucleotide
attaatacttgtaatgactctcgtatcttagt

SEQ ID NO: 2213 - DNA, 32 bp, Artificial Sequence
  Synthetic polynucleotide
gcctggccggcgcggcctcccacagcaaatta

SEQ ID NO: 2214 - DNA, 32 bp, Artificial Sequence
  Synthetic polynucleotide
acccgagacttagatccgaatcgcaggagatc

SEQ ID NO: 2215 - DNA, 32 bp, Artificial Sequence
  Synthetic polynucleotide
agcaggtccccgctcgagtaattgtcgctttt

SEQ ID NO: 2216 - DNA, 32 bp, Artificial Sequence
  Synthetic polynucleotide
tttttttttgtcgaaatatttgactttttttt

SEQ ID NO: 2217 - DNA, 32 bp, Artificial Sequence
  Synthetic polynucleotide
aattcatattttttttttttttttacgacttt

SEQ ID NO: 2218 - DNA, 32 bp, Artificial Sequence
  Synthetic polynucleotide
cgtcactttttaaaccaccagttccacaaggg

SEQ ID NO: 2219 - DNA, 32 bp, Artificial Sequence
  Synthetic polynucleotide
gaggtggtgctgaggattccgcgtgctgttca

SEQ ID NO: 2220 - DNA, 32 bp, Artificial Sequence
  Synthetic polynucleotide
gccttgtctgacatcgccccggaagtttggaa

SEQ ID NO: 2221 - DNA, 32 bp, Artificial Sequence
  Synthetic polynucleotide
tcctcggtctgaagcgggcgatacgatggccg

SEQ ID NO: 2222 - DNA, 32 bp, Artificial Sequence
  Synthetic polynucleotide
agacactacctgcgaactggttttgctcgtat

SEQ ID NO: 2223 - DNA, 32 bp, Artificial Sequence
  Synthetic polynucleotide
ggagaatcgacttgatgattgccggcactgcc

SEQ ID NO: 2224 - DNA, 32 bp, Artificial Sequence
  Synthetic polynucleotide
gcttctcggctgccattctgatatattgacgc

SEQ ID NO: 2225 - DNA, 32 bp, Artificial Sequence
  Synthetic polynucleotide
ttttttttatctataccgagatgttttttttt

SEQ ID NO: 2226 - DNA, 32 bp, Artificial Sequence
  Synthetic polynucleotide
accgaagcttttttttttttttttcgtagttc

SEQ ID NO: 2227 - DNA, 32 bp, Artificial Sequence
  Synthetic polynucleotide
cccgagtcagacctgtcctagaacactcgccg

SEQ ID NO: 2228 - DNA, 32 bp, Artificial Sequence
  Synthetic polynucleotide
cacgacgaccgggtatcgcggaacttgccacc

SEQ ID NO: 2229 - DNA, 32 bp, Artificial Sequence
  Synthetic polynucleotide
gctctaaacagcattaatcatgagtaggcgga

SEQ ID NO: 2230 - DNA, 32 bp, Artificial Sequence
  Synthetic polynucleotide
ccgagattacggccgggaggagcggtggaaat

SEQ ID NO: 2231 - DNA, 32 bp, Artificial Sequence
  Synthetic polynucleotide
ccctccactaaggaattaggcaagttttttgt

SEQ ID NO: 2232 - DNA, 32 bp, Artificial Sequence
  Synthetic polynucleotide
gccagtagaataactttgcggcgcagggtgta

SEQ ID NO: 2233 - DNA, 32 bp, Artificial Sequence
  Synthetic polynucleotide
ccatatgaatgaaaactaacagcataagaaca

SEQ ID NO: 2234 - DNA, 32 bp, Artificial Sequence
  Synthetic polynucleotide
tttttttttggtgtgtcccatggatttttttt

SEQ ID NO: 2235 - DNA, 32 bp, Artificial Sequence
  Synthetic polynucleotide
acactaattttttttttttttttttccagaat

SEQ ID NO: 2236 - DNA, 32 bp, Artificial Sequence
  Synthetic polynucleotide
tctgatggtgctgggtgaccacgtcctctcct

SEQ ID NO: 2237 - DNA, 32 bp, Artificial Sequence
  Synthetic polynucleotide
tataaagccagctccaagcacgtagagataat

SEQ ID NO: 2238 - DNA, 32 bp, Artificial Sequence
  Synthetic polynucleotide
actcgctacgggaatttaacacttggtctcga

SEQ ID NO: 2239 - DNA, 32 bp, Artificial Sequence
  Synthetic polynucleotide
tgccatgatatctcttgttatacaggtccggc

SEQ ID NO: 2240 - DNA, 32 bp, Artificial Sequence
  Synthetic polynucleotide
attcggatttcgtttaatagaatgctattgag

SEQ ID NO: 2241 - DNA, 32 bp, Artificial Sequence
  Synthetic polynucleotide
ccgaattacgtaccttaaaccgttatggtttc

SEQ ID NO: 2242 - DNA, 32 bp, Artificial Sequence
  Synthetic polynucleotide
tggctcgtgccgggcttcctgtcggttcccct

SEQ ID NO: 2243 - DNA, 32 bp, Artificial Sequence
  Synthetic polynucleotide
ttttttttctaggtggaacagtgatttttttt

SEQ ID NO: 2244 - DNA, 32 bp, Artificial Sequence
  Synthetic polynucleotide
caattcccttttttttttttttttcatcgccg

SEQ ID NO: 2245 - DNA, 32 bp, Artificial Sequence
  Synthetic polynucleotide
gaaaactgcttgtactttatattacggtttac

SEQ ID NO: 2246 - DNA, 32 bp, Artificial Sequence
  Synthetic polynucleotide
caacatttcctcaagctacgctatggggcata

SEQ ID NO: 2247 - DNA, 32 bp, Artificial Sequence
  Synthetic polynucleotide
cagtgcggatctcagcccacaaagagccattt

SEQ ID NO: 2248 - DNA, 32 bp, Artificial Sequence
  Synthetic polynucleotide
tgatcctgtcagattctacttgaattacttgg

SEQ ID NO: 2249 - DNA, 32 bp, Artificial Sequence
  Synthetic polynucleotide
taccgagcgtcaacttacttaataccgtcgat

SEQ ID NO: 2250 - DNA, 32 bp, Artificial Sequence
  Synthetic polynucleotide
tgttttcgacatggtcaattcatcgtcctcac

SEQ ID NO: 2251 - DNA, 32 bp, Artificial Sequence
  Synthetic polynucleotide
aattagaatatgccctgaattatataattata

SEQ ID NO: 2252 - DNA, 32 bp, Artificial Sequence
  Synthetic polynucleotide
ttttttttaaagtattgatgctattttttttt

SEQ ID NO: 2253 - DNA, 32 bp, Artificial Sequence
  Synthetic polynucleotide
cgctgatcttttttttttttttttaccctaac

SEQ ID NO: 2254 - DNA, 32 bp, Artificial Sequence
  Synthetic polynucleotide
accattgtgtcgaattcataccgtgcgtagct

SEQ ID NO: 2255 - DNA, 32 bp, Artificial Sequence
  Synthetic polynucleotide
acctatatcaaaagatgatgaacaacccatcc

SEQ ID NO: 2256 - DNA, 32 bp, Artificial Sequence
  Synthetic polynucleotide
gggagctgggtgtcagccccttcgattccacg

SEQ ID NO: 2257 - DNA, 32 bp, Artificial Sequence
  Synthetic polynucleotide
atcgctcaacttacctttatcatgcatttctt

SEQ ID NO: 2258 - DNA, 32 bp, Artificial Sequence
  Synthetic polynucleotide
attactggggtcattgacgggacaagcgggtc

SEQ ID NO: 2259 - DNA, 32 bp, Artificial Sequence
  Synthetic polynucleotide
cttccatgttcaggctagtgtctcgagaaccg

SEQ ID NO: 2260 - DNA, 32 bp, Artificial Sequence
  Synthetic polynucleotide
gccgatgggaactctggctaagggcctcagaa

SEQ ID NO: 2261 - DNA, 32 bp, Artificial Sequence
  Synthetic polynucleotide
tttttttttcaatttttactggagtttttttt

SEQ ID NO: 2262 - DNA, 32 bp, Artificial Sequence
  Synthetic polynucleotide
cctaggcgttttttttttttttttctaagccg

SEQ ID NO: 2263 - DNA, 32 bp, Artificial Sequence
  Synthetic polynucleotide
caggcaaggaggttagtattgaagaagcgggt

SEQ ID NO: 2264 - DNA, 32 bp, Artificial Sequence
  Synthetic polynucleotide
agttagattattggcccttcgtcatgacggag

SEQ ID NO: 2265 - DNA, 32 bp, Artificial Sequence
  Synthetic polynucleotide
cgaccattaaaaatcattacacatttggggac

SEQ ID NO: 2266 - DNA, 32 bp, Artificial Sequence
  Synthetic polynucleotide
ctagtaaccatattgtaccaatcataatgatc

SEQ ID NO: 2267 - DNA, 32 bp, Artificial Sequence
  Synthetic polynucleotide
ggtagaagcaaggcgccactccaagtgaaccc

SEQ ID NO: 2268 - DNA, 32 bp, Artificial Sequence
  Synthetic polynucleotide
cgtttattcattaagattctgctagtacaaat

SEQ ID NO: 2269 - DNA, 32 bp, Artificial Sequence
  Synthetic polynucleotide
aatgttctttaagtatacattactgtcaagac

SEQ ID NO: 2270 - DNA, 32 bp, Artificial Sequence
  Synthetic polynucleotide
ttttttttcgaacccgcgttactgtttttttt

SEQ ID NO: 2271 - DNA, 32 bp, Artificial Sequence
  Synthetic polynucleotide
tgtaccatttttttttttttttttggtgatct

SEQ ID NO: 2272 - DNA, 32 bp, Artificial Sequence
  Synthetic polynucleotide
gagctcacatgctgggtggtcggtcgcattca

SEQ ID NO: 2273 - DNA, 32 bp, Artificial Sequence
  Synthetic polynucleotide
tgggagaaccacgtagagccgaacttgattta

SEQ ID NO: 2274 - DNA, 32 bp, Artificial Sequence
  Synthetic polynucleotide
aagagcaatatccattcggacggaaaactaca

SEQ ID NO: 2275 - DNA, 32 bp, Artificial Sequence
  Synthetic polynucleotide
ctgtatgaagacgtcccagagcgtgattgcgc

SEQ ID NO: 2276 - DNA, 32 bp, Artificial Sequence
  Synthetic polynucleotide
agggttcaagacaatgcgtcccatgcgccgtg

SEQ ID NO: 2277 - DNA, 32 bp, Artificial Sequence
  Synthetic polynucleotide
gcccgacgcgatagtagattgggtctgtgctc

SEQ ID NO: 2278 - DNA, 32 bp, Artificial Sequence
  Synthetic polynucleotide
agtctacgcgaaggtcgctgtgccatgtgaag

SEQ ID NO: 2279 - DNA, 32 bp, Artificial Sequence
  Synthetic polynucleotide
ttttttttttatgtgagataatactttttttt

SEQ ID NO: 2280 - DNA, 32 bp, Artificial Sequence
  Synthetic polynucleotide
ccaccttattttttttttttttttccccgctc

SEQ ID NO: 2281 - DNA, 32 bp, Artificial Sequence
  Synthetic polynucleotide
tcgtattaggtcggccgttgttcctgtccgtg

SEQ ID NO: 2282 - DNA, 32 bp, Artificial Sequence
  Synthetic polynucleotide
ggtattttttgtcgttagtgtttttatcaaag

SEQ ID NO: 2283 - DNA, 32 bp, Artificial Sequence
  Synthetic polynucleotide
gtaatggtccggcgaacatacacacgggcatc

SEQ ID NO: 2284 - DNA, 32 bp, Artificial Sequence
  Synthetic polynucleotide
acctaatgcgcctccgctgaaggagggcacga

SEQ ID NO: 2285 - DNA, 32 bp, Artificial Sequence
  Synthetic polynucleotide
actgaaagtataataggcggcgaaccacaatg

SEQ ID NO: 2286 - DNA, 32 bp, Artificial Sequence
  Synthetic polynucleotide
aggtcatcacactcacttacgcccatctatgt

SEQ ID NO: 2287 - DNA, 32 bp, Artificial Sequence
  Synthetic polynucleotide
ccatattaaggctgcggaagaggtgagaacat

SEQ ID NO: 2288 - DNA, 32 bp, Artificial Sequence
  Synthetic polynucleotide
ttttttttggtaatcctaggtggttttttttt

SEQ ID NO: 2289 - DNA, 32 bp, Artificial Sequence
  Synthetic polynucleotide
ataccctattttttttttttttttatcacata

SEQ ID NO: 2290 - DNA, 32 bp, Artificial Sequence
  Synthetic polynucleotide
gcatgagattacgagttttgcaccacctatac

SEQ ID NO: 2291 - DNA, 32 bp, Artificial Sequence
  Synthetic polynucleotide
ggttcgtgcctgcttcggagtcatctcggcat

SEQ ID NO: 2292 - DNA, 32 bp, Artificial Sequence
  Synthetic polynucleotide
cccgacaagatgcgttaatattgcagtattcc

SEQ ID NO: 2293 - DNA, 32 bp, Artificial Sequence
  Synthetic polynucleotide
gaacgatatgacaggtttctgaatcgcgggct

SEQ ID NO: 2294 - DNA, 32 bp, Artificial Sequence
  Synthetic polynucleotide
gcgcgggcattttatagatagagaactgtccc

SEQ ID NO: 2295 - DNA, 32 bp, Artificial Sequence
  Synthetic polynucleotide
gatgatattaggttatcgtaggagttgaccta

SEQ ID NO: 2296 - DNA, 32 bp, Artificial Sequence
  Synthetic polynucleotide
tggaatacacattgtaatcccggatcttgtat

SEQ ID NO: 2297 - DNA, 32 bp, Artificial Sequence
  Synthetic polynucleotide
ttttttttcagctggactagagcttttttttt

SEQ ID NO: 2298 - DNA, 32 bp, Artificial Sequence
  Synthetic polynucleotide
gctgatgcttttttttttttttttcgcggaca

SEQ ID NO: 2299 - DNA, 32 bp, Artificial Sequence
  Synthetic polynucleotide
cgtgggacacctgccagtgccgtaccggcgga

SEQ ID NO: 2300 - DNA, 32 bp, Artificial Sequence
  Synthetic polynucleotide
tatcgtcctttaaagagtgcgcttatagtgga

SEQ ID NO: 2301 - DNA, 32 bp, Artificial Sequence
  Synthetic polynucleotide
ctgaatggggcgcagactgcttttgcgcccac

SEQ ID NO: 2302 - DNA, 32 bp, Artificial Sequence
  Synthetic polynucleotide
gacccaggcctgtgaactctccgccggcgaaa

SEQ ID NO: 2303 - DNA, 32 bp, Artificial Sequence
  Synthetic polynucleotide
ttacctgcggcagcagacacagtgtacgtctt

SEQ ID NO: 2304 - DNA, 32 bp, Artificial Sequence
  Synthetic polynucleotide
tcacatacttttgcatgcagggtgcacaggat

SEQ ID NO: 2305 - DNA, 32 bp, Artificial Sequence
  Synthetic polynucleotide
ctgctccttgactcttaattatcacatgttgt

SEQ ID NO: 2306 - DNA, 32 bp, Artificial Sequence
  Synthetic polynucleotide
ttttttttgacccaaagcggtaactttttttt

SEQ ID NO: 2307 - DNA, 32 bp, Artificial Sequence
  Synthetic polynucleotide
atcggattttttttttttttttttcttctttc

SEQ ID NO: 2308 - DNA, 48 bp, Artificial Sequence
  Synthetic polynucleotide
ggggactcttagggtcttgtcttagtagttaaatgaatccactacacc

SEQ ID NO: 2309 - DNA, 32 bp, Artificial Sequence
  Synthetic polynucleotide
actcgtcgtattcttcctgctgtagactcgag

SEQ ID NO: 2310 - DNA, 48 bp, Artificial Sequence
  Synthetic polynucleotide
gtcggaagatgccgttcaacacaaaatgtattagtcaatccctgctcc

SEQ ID NO: 2311 - DNA, 32 bp, Artificial Sequence
  Synthetic polynucleotide
tattgctctataaaaaagatgcgagccctaac

SEQ ID NO: 2312 - DNA, 48 bp, Artificial Sequence
  Synthetic polynucleotide
aactcatatcaatttctcatggtatcaccctacagactactccccgga

SEQ ID NO: 2313 - DNA, 32 bp, Artificial Sequence
  Synthetic polynucleotide
ctccgcattgcagggtagtaacgctttgtacg

SEQ ID NO: 2314 - DNA, 48 bp, Artificial Sequence
  Synthetic polynucleotide
gcgacgctgcctacctgtgtacctggctataccacttgactttttttt

SEQ ID NO: 2315 - DNA, 32 bp, Artificial Sequence
  Synthetic polynucleotide
ttttttttcactttaaagacatagtttttttt

SEQ ID NO: 2316 - DNA, 32 bp, Artificial Sequence
  Synthetic polynucleotide
cggcgccgttttttttttttttttctacaact

SEQ ID NO: 2317 - DNA, 48 bp, Artificial Sequence
  Synthetic polynucleotide
cttacttgtgatcaatctgtactacgaagtctcatcacggttgcgggg

SEQ ID NO: 2318 - DNA, 32 bp, Artificial Sequence
  Synthetic polynucleotide
cccggtggacgccctgaggatggcgcccacca

SEQ ID NO: 2319 - DNA, 48 bp, Artificial Sequence
  Synthetic polynucleotide
ctggtctcggaacagaccacggaaggtatgctatcccctctaacggcc

SEQ ID NO: 2320 - DNA, 32 bp, Artificial Sequence
  Synthetic polynucleotide
agccagagccggacgcgtggcgctttgttcat

SEQ ID NO: 2321 - DNA, 48 bp, Artificial Sequence
  Synthetic polynucleotide
gctcattccttggtaagatcacccaaggagatcgatagaaacaatttc

SEQ ID NO: 2322 - DNA, 32 bp, Artificial Sequence
  Synthetic polynucleotide
ggttgcggggtgcgtccaaagggcggcactag

SEQ ID NO: 2323 - DNA, 48 bp, Artificial Sequence
  Synthetic polynucleotide
actgtagtcacgtaaaaacatggtatcgctgacgccgtgttttttttt

SEQ ID NO: 2324 - DNA, 32 bp, Artificial Sequence
  Synthetic polynucleotide
ttttttttcccggtcatttacgcttttttttt

SEQ ID NO: 2325 - DNA, 32 bp, Artificial Sequence
  Synthetic polynucleotide
acttggactttttttttttttttttagcgcct

SEQ ID NO: 2326 - DNA, 48 bp, Artificial Sequence
  Synthetic polynucleotide
taacaaggttgcccttgcggatgcatataactatattgtatggctggt

SEQ ID NO: 2327 - DNA, 32 bp, Artificial Sequence
  Synthetic polynucleotide
gcgccagatgccatcggatatcgcggctccaa

SEQ ID NO: 2328 - DNA, 48 bp, Artificial Sequence
  Synthetic polynucleotide
gaaggctgctaagccgagaactcttgatgtcctacgatgaaacggttt

SEQ ID NO: 2329 - DNA, 32 bp, Artificial Sequence
  Synthetic polynucleotide
aaactgagcccgcggtgcactaagcgtagtgg

SEQ ID NO: 2330 - DNA, 48 bp, Artificial Sequence
  Synthetic polynucleotide
atgttccgtgaatcttgcgcccacctgtttaaaagttgaacctgggaa

SEQ ID NO: 2331 - DNA, 32 bp, Artificial Sequence
  Synthetic polynucleotide
gccaaaatcatcgtgcacagtgccatcgccaa

SEQ ID NO: 2332 - DNA, 48 bp, Artificial Sequence
  Synthetic polynucleotide
ctgctgaacccgttcctcaaggaagagtacattcgcacgatttttttt

SEQ ID NO: 2333 - DNA, 32 bp, Artificial Sequence
  Synthetic polynucleotide
ttttttttgagtaaggggtcagactttttttt

SEQ ID NO: 2334 - DNA, 48 bp, Artificial Sequence
  Synthetic polynucleotide
acatgaggcaaggacgcgatgctttttttttttttttttttgacaccc

SEQ ID NO: 2335 - DNA, 48 bp, Artificial Sequence
  Synthetic polynucleotide
cagagatggcgagataggcggatacgaccgttatattgctaaagtgag

SEQ ID NO: 2336 - DNA, 48 bp, Artificial Sequence
  Synthetic polynucleotide
accttcaactccattgcccgcgtacgtcgaggaaatacgaaaaacgac

SEQ ID NO: 2337 - DNA, 48 bp, Artificial Sequence
  Synthetic polynucleotide
ttgtgaactcgtctacgactctactggttcaacgtgacggtaagacct

SEQ ID NO: 2338 - DNA, 32 bp, Artificial Sequence
  Synthetic polynucleotide
tttttttttagccagccgtcctgttttttttt

SEQ ID NO: 2339 - DNA, 16 bp, Artificial Sequence
  Synthetic polynucleotide
ttttttttccatgcga

SEQ ID NO: 2340 - DNA, 48 bp, Artificial Sequence
  Synthetic polynucleotide
cgaacgcattgccacacatcttaattttttttttttttttttgcgctt

SEQ ID NO: 2341 - DNA, 48 bp, Artificial Sequence
  Synthetic polynucleotide
ttgtgctgagggctgcgactctctgcaggcgtttaaccataaggtccg

SEQ ID NO: 2342 - DNA, 48 bp, Artificial Sequence
  Synthetic polynucleotide
ttgttgcgtcgggacaagtgtggtgcgagggttgctcaatatgtgtac

SEQ ID NO: 2343 - DNA, 48 bp, Artificial Sequence
  Synthetic polynucleotide
tagatgcgagataggtctcaataatttgcattgttagtggtggcaccc

SEQ ID NO: 2344 - DNA, 32 bp, Artificial Sequence
  Synthetic polynucleotide
ttttttttttgctaggtccctaaatttttttt

SEQ ID NO: 2345 - DNA, 16 bp, Artificial Sequence
  Synthetic polynucleotide
ttttttttcactccca

SEQ ID NO: 2346 - DNA, 48 bp, Artificial Sequence
  Synthetic polynucleotide
taacatcgtgctgtagagcgtgatttttttttttttttttaggcctcg

SEQ ID NO: 2347 - DNA, 48 bp, Artificial Sequence
  Synthetic polynucleotide
gattcatacccctcagcgatgcggttaggtaagaatatccccggttga

SEQ ID NO: 2348 - DNA, 48 bp, Artificial Sequence
  Synthetic polynucleotide
cgggtatacacagcacattacgaccgtgtctgccagcagtaaacgtcc

SEQ ID NO: 2349 - DNA, 48 bp, Artificial Sequence
  Synthetic polynucleotide
gtgctgcggcctcgtgtcggcagcgagcttgcgagccgatggagtgtt

SEQ ID NO: 2350 - DNA, 32 bp, Artificial Sequence
  Synthetic polynucleotide
ttttttttggagcgtacttggacatttttttt

SEQ ID NO: 2351 - DNA, 16 bp, Artificial Sequence
  Synthetic polynucleotide
tttttttttgttctac

SEQ ID NO: 2352 - DNA, 48 bp, Artificial Sequence; identical to SEQ ID NO: 82
  Synthetic polynucleotide

SEQ ID NO: 2353 - DNA, 32 bp, Artificial Sequence; identical to SEQ ID NO: 83
  Synthetic polynucleotide

SEQ ID NO: 2354 - DNA, 48 bp, Artificial Sequence; identical to SEQ ID NO: 84
  Synthetic polynucleotide

SEQ ID NO: 2355 - DNA, 32 bp, Artificial Sequence; identical to SEQ ID NO: 6
  Synthetic polynucleotide

SEQ ID NO: 2356 - DNA, 48 bp, Artificial Sequence; identical to SEQ ID NO: 1897
  Synthetic polynucleotide

SEQ ID NO: 2357 - DNA, 32 bp, Artificial Sequence; identical to SEQ ID NO: 1898
  Synthetic polynucleotide

SEQ ID NO: 2358 - DNA, 48 bp, Artificial Sequence; identical to SEQ ID NO: 1899
  Synthetic polynucleotide

SEQ ID NO: 2359 - DNA, 32 bp, Artificial Sequence; identical to SEQ ID NO: 11
  Synthetic polynucleotide

SEQ ID NO: 2360 - DNA, 32 bp, Artificial Sequence; identical to SEQ ID NO: 1901
  Synthetic polynucleotide

SEQ ID NO: 2361 - DNA, 32 bp, Artificial Sequence; identical to SEQ ID NO: 1902
  Synthetic polynucleotide

SEQ ID NO: 2362 - DNA, 32 bp, Artificial Sequence; identical to SEQ ID NO: 348
  Synthetic polynucleotide

SEQ ID NO: 2363 - DNA, 32 bp, Artificial Sequence; identical to SEQ ID NO: 17
  Synthetic polynucleotide

SEQ ID NO: 2364 - DNA, 32 bp, Artificial Sequence; identical to SEQ ID NO: 18
  Synthetic polynucleotide

SEQ ID NO: 2365 - DNA, 32 bp, Artificial Sequence; identical to SEQ ID NO: 19
  Synthetic polynucleotide

SEQ ID NO: 2366 - DNA, 32 bp, Artificial Sequence; identical to SEQ ID NO: 20
  Synthetic polynucleotide

SEQ ID NO: 2367 - DNA, 32 bp, Artificial Sequence; identical to SEQ ID NO: 21
  Synthetic polynucleotide

SEQ ID NO: 2368 - DNA, 48 bp, Artificial Sequence; identical to SEQ ID NO: 1909
  Synthetic polynucleotide

SEQ ID NO: 2369 - DNA, 48 bp, Artificial Sequence; identical to SEQ ID NO: 1910
  Synthetic polynucleotide

SEQ ID NO: 2370 - DNA, 48 bp, Artificial Sequence; identical to SEQ ID NO: 357
  Synthetic polynucleotide

SEQ ID NO: 2371 - DNA, 48 bp, Artificial Sequence; identical to SEQ ID NO: 1912
  Synthetic polynucleotide

SEQ ID NO: 2372 - DNA, 16 bp, Artificial Sequence
  Synthetic polynucleotide
gcctaaaggtccttcc

SEQ ID NO: 2373 - DNA, 32 bp, Artificial Sequence; identical to SEQ ID NO: 1914
  Synthetic polynucleotide

SEQ ID NO: 2374 - DNA, 48 bp, Artificial Sequence; identical to SEQ ID NO: 1915
  Synthetic polynucleotide

SEQ ID NO: 2375 - DNA, 32 bp, Artificial Sequence; identical to SEQ ID NO: 33
  Synthetic polynucleotide

SEQ ID NO: 2376 - DNA, 48 bp, Artificial Sequence; identical to SEQ ID NO: 1917
  Synthetic polynucleotide

SEQ ID NO: 2377 - DNA, 32 bp, Artificial Sequence; identical to SEQ ID NO: 1918
  Synthetic polynucleotide

SEQ ID NO: 2378 - DNA, 48 bp, Artificial Sequence; identical to SEQ ID NO: 1919
  Synthetic polynucleotide

SEQ ID NO: 2379 - DNA, 32 bp, Artificial Sequence; identical to SEQ ID NO: 38
  Synthetic polynucleotide

SEQ ID NO: 2380 - DNA, 32 bp, Artificial Sequence; identical to SEQ ID NO: 39
  Synthetic polynucleotide

SEQ ID NO: 2381 - DNA, 32 bp, Artificial Sequence; identical to SEQ ID NO: 1922
  Synthetic polynucleotide

SEQ ID NO: 2382 - DNA, 32 bp, Artificial Sequence; identical to SEQ ID NO: 1923
  Synthetic polynucleotide

SEQ ID NO: 2383 - DNA, 32 bp, Artificial Sequence; identical to SEQ ID NO: 370
  Synthetic polynucleotide

SEQ ID NO: 2384 - DNA, 32 bp, Artificial Sequence; identical to SEQ ID NO: 45
  Synthetic polynucleotide

SEQ ID NO: 2385 - DNA, 32 bp, Artificial Sequence; identical to SEQ ID NO: 46
  Synthetic polynucleotide

SEQ ID NO: 2386 - DNA, 32 bp, Artificial Sequence; identical to SEQ ID NO: 47
  Synthetic polynucleotide

SEQ ID NO: 2387 - DNA, 32 bp, Artificial Sequence; identical to SEQ ID NO: 48
  Synthetic polynucleotide

SEQ ID NO: 2388 - DNA, 32 bp, Artificial Sequence; identical to SEQ ID NO: 49
  Synthetic polynucleotide

SEQ ID NO: 2389 - DNA, 16 bp, Artificial Sequence
  Synthetic polynucleotide
agcacgaggattatca

SEQ ID NO: 2390 - DNA, 48 bp, Artificial Sequence; identical to SEQ ID NO: 1931
  Synthetic polynucleotide

SEQ ID NO: 2391 - DNA, 48 bp, Artificial Sequence; identical to SEQ ID NO: 1932
  Synthetic polynucleotide

SEQ ID NO: 2392 - DNA, 48 bp, Artificial Sequence; identical to SEQ ID NO: 244
  Synthetic polynucleotide

SEQ ID NO: 2393 - DNA, 32 bp, Artificial Sequence; identical to SEQ ID NO: 56
  Synthetic polynucleotide

SEQ ID NO: 2394 - DNA, 48 bp, Artificial Sequence; identical to SEQ ID NO: 251
  Synthetic polynucleotide

SEQ ID NO: 2395 - DNA, 32 bp, Artificial Sequence; identical to SEQ ID NO: 252
  Synthetic polynucleotide

SEQ ID NO: 2396 - DNA, 48 bp, Artificial Sequence; identical to SEQ ID NO: 253
  Synthetic polynucleotide

SEQ ID NO: 2397 - DNA, 32 bp, Artificial Sequence; identical to SEQ ID NO: 62
  Synthetic polynucleotide

SEQ ID NO: 2398 - DNA, 48 bp, Artificial Sequence; identical to SEQ ID NO: 1939
  Synthetic polynucleotide

SEQ ID NO: 2399 - DNA, 32 bp, Artificial Sequence; identical to SEQ ID NO: 1940
  Synthetic polynucleotide

SEQ ID NO: 2400 - DNA, 48 bp, Artificial Sequence; identical to SEQ ID NO: 1941
  Synthetic polynucleotide

SEQ ID NO: 2401 - DNA, 32 bp, Artificial Sequence; identical to SEQ ID NO: 67
  Synthetic polynucleotide

SEQ ID NO: 2402 - DNA, 32 bp, Artificial Sequence; identical to SEQ ID NO: 1943
  Synthetic polynucleotide

SEQ ID NO: 2403 - DNA, 32 bp, Artificial Sequence; identical to SEQ ID NO: 936
  Synthetic polynucleotide

SEQ ID NO: 2404 - DNA, 32 bp, Artificial Sequence; identical to SEQ ID NO: 392
  Synthetic polynucleotide

SEQ ID NO: 2405 - DNA, 32 bp, Artificial Sequence; identical to SEQ ID NO: 73
  Synthetic polynucleotide

SEQ ID NO: 2406 - DNA, 32 bp, Artificial Sequence; identical to SEQ ID NO: 74
  Synthetic polynucleotide

SEQ ID NO: 2407 - DNA, 32 bp, Artificial Sequence; identical to SEQ ID NO: 75
  Synthetic polynucleotide

SEQ ID NO: 2408 - DNA, 32 bp, Artificial Sequence; identical to SEQ ID NO: 76
  Synthetic polynucleotide

SEQ ID NO: 2409 - DNA, 32 bp, Artificial Sequence; identical to SEQ ID NO: 77
  Synthetic polynucleotide

SEQ ID NO: 2410 - DNA, 48 bp, Artificial Sequence; identical to SEQ ID NO: 1951
  Synthetic polynucleotide

SEQ ID NO: 2411 - DNA, 48 bp, Artificial Sequence; identical to SEQ ID NO: 1952
  Synthetic polynucleotide

SEQ ID NO: 2412 - DNA, 48 bp, Artificial Sequence; identical to SEQ ID NO: 401
  Synthetic polynucleotide

SEQ ID NO: 2413 - DNA, 48 bp, Artificial Sequence; identical to SEQ ID NO: 946
  Synthetic polynucleotide

SEQ ID NO: 2414 - DNA, 16 bp, Artificial Sequence
  Synthetic polynucleotide
ttaagacggccggtgt

SEQ ID NO: 2415 - DNA, 32 bp, Artificial Sequence; identical to SEQ ID NO: 1956
  Synthetic polynucleotide

SEQ ID NO: 2416 - DNA, 48 bp, Artificial Sequence; identical to SEQ ID NO: 948
  Synthetic polynucleotide

SEQ ID NO: 2417 - DNA, 32 bp, Artificial Sequence; identical to SEQ ID NO: 1958
  Synthetic polynucleotide

SEQ ID NO: 2418 - DNA, 48 bp, Artificial Sequence; identical to SEQ ID NO: 1959
  Synthetic polynucleotide

SEQ ID NO: 2419 - DNA, 32 bp, Artificial Sequence; identical to SEQ ID NO: 1960
  Synthetic polynucleotide

SEQ ID NO: 2420 - DNA, 48 bp, Artificial Sequence; identical to SEQ ID NO: 1961
  Synthetic polynucleotide

SEQ ID NO: 2421 - DNA, 32 bp, Artificial Sequence; identical to SEQ ID NO: 410
  Synthetic polynucleotide

SEQ ID NO: 2422 - DNA, 32 bp, Artificial Sequence; identical to SEQ ID NO: 1963
  Synthetic polynucleotide

SEQ ID NO: 2423 - DNA, 32 bp, Artificial Sequence; identical to SEQ ID NO: 1964
  Synthetic polynucleotide

SEQ ID NO: 2424 - DNA, 32 bp, Artificial Sequence; identical to SEQ ID NO: 1965
  Synthetic polynucleotide

SEQ ID NO: 2425 - DNA, 32 bp, Artificial Sequence; identical to SEQ ID NO: 414
  Synthetic polynucleotide

SEQ ID NO: 2426 - DNA, 32 bp, Artificial Sequence; identical to SEQ ID NO: 1967
  Synthetic polynucleotide

SEQ ID NO: 2427 - DNA, 32 bp, Artificial Sequence; identical to SEQ ID NO: 1968
  Synthetic polynucleotide

SEQ ID NO: 2428 - DNA, 32 bp, Artificial Sequence; identical to SEQ ID NO: 418
  Synthetic polynucleotide

SEQ ID NO: 2429 - DNA, 32 bp, Artificial Sequence; identical to SEQ ID NO: 416
  Synthetic polynucleotide

SEQ ID NO: 2430 - DNA, 32 bp, Artificial Sequence; identical to SEQ ID NO: 419
  Synthetic polynucleotide

SEQ ID NO: 2431 - DNA, 16 bp, Artificial Sequence
  Synthetic polynucleotide
cagcttgacgcaagac

SEQ ID NO: 2432 - DNA, 48 bp, Artificial Sequence; identical to SEQ ID NO: 1973
  Synthetic polynucleotide

SEQ ID NO: 2433 - DNA, 48 bp, Artificial Sequence; identical to SEQ ID NO: 965
  Synthetic polynucleotide

SEQ ID NO: 2434 - DNA, 48 bp, Artificial Sequence; identical to SEQ ID NO: 1975
  Synthetic polynucleotide

SEQ ID NO: 2435 - DNA, 32 bp, Artificial Sequence; identical to SEQ ID NO: 1976
  Synthetic polynucleotide

SEQ ID NO: 2436 - DNA, 48 bp, Artificial Sequence; identical to SEQ ID NO: 425
  Synthetic polynucleotide

SEQ ID NO: 2437 - DNA, 32 bp, Artificial Sequence; identical to SEQ ID NO: 427
  Synthetic polynucleotide

SEQ ID NO: 2438 - DNA, 48 bp, Artificial Sequence; identical to SEQ ID NO: 426
  Synthetic polynucleotide

SEQ ID NO: 2439 - DNA, 32 bp, Artificial Sequence; identical to SEQ ID NO: 428
  Synthetic polynucleotide

SEQ ID NO: 2440 - DNA, 48 bp, Artificial Sequence; identical to SEQ ID NO: 1981
  Synthetic polynucleotide

SEQ ID NO: 2441 - DNA, 32 bp, Artificial Sequence; identical to SEQ ID NO: 1982
  Synthetic polynucleotide

SEQ ID NO: 2442 - DNA, 48 bp, Artificial Sequence; identical to SEQ ID NO: 974
  Synthetic polynucleotide

SEQ ID NO: 2443 - DNA, 32 bp, Artificial Sequence; identical to SEQ ID NO: 1984
  Synthetic polynucleotide

SEQ ID NO: 2444 - DNA, 32 bp, Artificial Sequence; identical to SEQ ID NO: 1985
  Synthetic polynucleotide

SEQ ID NO: 2445 - DNA, 32 bp, Artificial Sequence; identical to SEQ ID NO: 1986
  Synthetic polynucleotide

SEQ ID NO: 2446 - DNA, 32 bp, Artificial Sequence; identical to SEQ ID NO: 436
  Synthetic polynucleotide

SEQ ID NO: 2447 - DNA, 32 bp, Artificial Sequence; identical to SEQ ID NO: 1988
  Synthetic polynucleotide

SEQ ID NO: 2448 - DNA, 32 bp, Artificial Sequence; identical to SEQ ID NO: 1989
  Synthetic polynucleotide

SEQ ID NO: 2449 - DNA, 32 bp, Artificial Sequence; identical to SEQ ID NO: 440
  Synthetic polynucleotide

SEQ ID NO: 2450 - DNA, 32 bp, Artificial Sequence; identical to SEQ ID NO: 438
  Synthetic polynucleotide

SEQ ID NO: 2451 - DNA, 32 bp, Artificial Sequence; identical to SEQ ID NO: 441
  Synthetic polynucleotide

SEQ ID NO: 2452 - DNA, 48 bp, Artificial Sequence; identical to SEQ ID NO: 1993
  Synthetic polynucleotide

SEQ ID NO: 2453 - DNA, 48 bp, Artificial Sequence; identical to SEQ ID NO: 1994
  Synthetic polynucleotide

SEQ ID NO: 2454 - DNA, 48 bp, Artificial Sequence; identical to SEQ ID NO: 445
  Synthetic polynucleotide

SEQ ID NO: 2455 - DNA, 48 bp, Artificial Sequence; identical to SEQ ID NO: 1996
  Synthetic polynucleotide

SEQ ID NO: 2456 - DNA, 16 bp, Artificial Sequence
  Synthetic polynucleotide
gcttcggtacaggtct

SEQ ID NO: 2457 - DNA, 32 bp, Artificial Sequence; identical to SEQ ID NO: 1998
  Synthetic polynucleotide

SEQ ID NO: 2458 - DNA, 48 bp, Artificial Sequence; identical to SEQ ID NO: 1999
  Synthetic polynucleotide

SEQ ID NO: 2459 - DNA, 32 bp, Artificial Sequence; identical to SEQ ID NO: 2000
  Synthetic polynucleotide

SEQ ID NO: 2460 - DNA, 48 bp, Artificial Sequence; identical to SEQ ID NO: 2001
  Synthetic polynucleotide

SEQ ID NO: 2461 - DNA, 32 bp, Artificial Sequence; identical to SEQ ID NO: 2002
  Synthetic polynucleotide

SEQ ID NO: 2462 - DNA, 48 bp, Artificial Sequence; identical to SEQ ID NO: 2003
  Synthetic polynucleotide

SEQ ID NO: 2463 - DNA, 32 bp, Artificial Sequence; identical to SEQ ID NO: 2004
  Synthetic polynucleotide

SEQ ID NO: 2464 - DNA, 32 bp, Artificial Sequence; identical to SEQ ID NO: 2005
  Synthetic polynucleotide

SEQ ID NO: 2465 - DNA, 32 bp, Artificial Sequence; identical to SEQ ID NO: 2006
  Synthetic polynucleotide

SEQ ID NO: 2466 - DNA, 32 bp, Artificial Sequence; identical to SEQ ID NO: 2007
  Synthetic polynucleotide

SEQ ID NO: 2467 - DNA, 32 bp, Artificial Sequence; identical to SEQ ID NO: 2008
  Synthetic polynucleotide

SEQ ID NO: 2468 - DNA, 32 bp, Artificial Sequence; identical to SEQ ID NO: 2009
  Synthetic polynucleotide

SEQ ID NO: 2469 - DNA, 32 bp, Artificial Sequence; identical to SEQ ID NO: 2010
  Synthetic polynucleotide

SEQ ID NO: 2470 - DNA, 32 bp, Artificial Sequence; identical to SEQ ID NO: 2011
  Synthetic polynucleotide

SEQ ID NO: 2471 - DNA, 32 bp, Artificial Sequence; identical to SEQ ID NO: 2012
  Synthetic polynucleotide

SEQ ID NO: 2472 - DNA, 32 bp, Artificial Sequence; identical to SEQ ID NO: 2013
  Synthetic polynucleotide

SEQ ID NO: 2473 - DNA, 16 bp, Artificial Sequence
  Synthetic polynucleotide
cacctcctgttagggt

SEQ ID NO: 2474 - DNA, 48 bp, Artificial Sequence; identical to SEQ ID NO: 2015
  Synthetic polynucleotide

SEQ ID NO: 2475 - DNA, 48 bp, Artificial Sequence; identical to SEQ ID NO: 2016
  Synthetic polynucleotide

SEQ ID NO: 2476 - DNA, 48 bp, Artificial Sequence; identical to SEQ ID NO: 2017
  Synthetic polynucleotide

SEQ ID NO: 2477 - DNA, 32 bp, Artificial Sequence; identical to SEQ ID NO: 2018
  Synthetic polynucleotide

SEQ ID NO: 2478 - DNA, 48 bp, Artificial Sequence; identical to SEQ ID NO: 2019
  Synthetic polynucleotide

SEQ ID NO: 2479 - DNA, 32 bp, Artificial Sequence; identical to SEQ ID NO: 2020
  Synthetic polynucleotide

SEQ ID NO: 2480 - DNA, 48 bp, Artificial Sequence; identical to SEQ ID NO: 2021
  Synthetic polynucleotide

SEQ ID NO: 2481 - DNA, 32 bp, Artificial Sequence; identical to SEQ ID NO: 2022
  Synthetic polynucleotide

SEQ ID NO: 2482 - DNA, 48 bp, Artificial Sequence; identical to SEQ ID NO: 2023
  Synthetic polynucleotide

SEQ ID NO: 2483 - DNA, 32 bp, Artificial Sequence; identical to SEQ ID NO: 2024
  Synthetic polynucleotide

SEQ ID NO: 2484 - DNA, 48 bp, Artificial Sequence; identical to SEQ ID NO: 2025
  Synthetic polynucleotide

SEQ ID NO: 2485 - DNA, 32 bp, Artificial Sequence; identical to SEQ ID NO: 2026
  Synthetic polynucleotide

SEQ ID NO: 2486 - DNA, 32 bp, Artificial Sequence; identical to SEQ ID NO: 2027
  Synthetic polynucleotide

SEQ ID NO: 2487 - DNA, 32 bp, Artificial Sequence; identical to SEQ ID NO: 2028
  Synthetic polynucleotide

SEQ ID NO: 2488 - DNA, 32 bp, Artificial Sequence; identical to SEQ ID NO: 1020
  Synthetic polynucleotide

SEQ ID NO: 2489 - DNA, 32 bp, Artificial Sequence; identical to SEQ ID NO: 2030
  Synthetic polynucleotide

SEQ ID NO: 2490 - DNA, 32 bp, Artificial Sequence; identical to SEQ ID NO: 2031
  Synthetic polynucleotide

SEQ ID NO: 2491 - DNA, 32 bp, Artificial Sequence; identical to SEQ ID NO: 2032
  Synthetic polynucleotide

SEQ ID NO: 2492 - DNA, 32 bp, Artificial Sequence; identical to SEQ ID NO: 2033
  Synthetic polynucleotide

SEQ ID NO: 2493 - DNA, 32 bp, Artificial Sequence; identical to SEQ ID NO: 2034
  Synthetic polynucleotide

SEQ ID NO: 2494 - DNA, 48 bp, Artificial Sequence; identical to SEQ ID NO: 1025
  Synthetic polynucleotide

SEQ ID NO: 2495 - DNA, 48 bp, Artificial Sequence; identical to SEQ ID NO: 1026
  Synthetic polynucleotide

SEQ ID NO: 2496 - DNA, 48 bp, Artificial Sequence; identical to SEQ ID NO: 2037
  Synthetic polynucleotide

SEQ ID NO: 2497 - DNA, 48 bp, Artificial Sequence; identical to SEQ ID NO: 2038
  Synthetic polynucleotide

SEQ ID NO: 2498 - DNA, 16 bp, Artificial Sequence
  Synthetic polynucleotide
taaggtggggccgacc

SEQ ID NO: 2499 - DNA, 32 bp, Artificial Sequence; identical to SEQ ID NO: 2040
  Synthetic polynucleotide

SEQ ID NO: 2500 - DNA, 48 bp, Artificial Sequence; identical to SEQ ID NO: 2041
  Synthetic polynucleotide

SEQ ID NO: 2501 - DNA, 32 bp, Artificial Sequence; identical to SEQ ID NO: 2042
  Synthetic polynucleotide

SEQ ID NO: 2502 - DNA, 48 bp, Artificial Sequence; identical to SEQ ID NO: 2043
  Synthetic polynucleotide

SEQ ID NO: 2503 - DNA, 32 bp, Artificial Sequence; identical to SEQ ID NO: 2044
  Synthetic polynucleotide

SEQ ID NO: 2504 - DNA, 48 bp, Artificial Sequence; identical to SEQ ID NO: 1037
  Synthetic polynucleotide

SEQ ID NO: 2505 - DNA, 32 bp, Artificial Sequence; identical to SEQ ID NO: 2046
  Synthetic polynucleotide

SEQ ID NO: 2506 - DNA, 32 bp, Artificial Sequence; identical to SEQ ID NO: 2047
  Synthetic polynucleotide

SEQ ID NO: 2507 - DNA, 32 bp, Artificial Sequence; identical to SEQ ID NO: 2048
  Synthetic polynucleotide

SEQ ID NO: 2508 - DNA, 32 bp, Artificial Sequence; identical to SEQ ID NO: 1040
  Synthetic polynucleotide

SEQ ID NO: 2509 - DNA, 32 bp, Artificial Sequence; identical to SEQ ID NO: 2050
  Synthetic polynucleotide

SEQ ID NO: 2510 - DNA, 32 bp, Artificial Sequence; identical to SEQ ID NO: 2051
  Synthetic polynucleotide

SEQ ID NO: 2511 - DNA, 32 bp, Artificial Sequence; identical to SEQ ID NO: 2052
  Synthetic polynucleotide

SEQ ID NO: 2512 - DNA, 32 bp, Artificial Sequence; identical to SEQ ID NO: 2053
  Synthetic polynucleotide

SEQ ID NO: 2513 - DNA, 32 bp, Artificial Sequence; identical to SEQ ID NO: 2054
  Synthetic polynucleotide

SEQ ID NO: 2514 - DNA, 32 bp, Artificial Sequence; identical to SEQ ID NO: 2055
  Synthetic polynucleotide

SEQ ID NO: 2515 - DNA, 16 bp, Artificial Sequence
  Synthetic polynucleotide
acggtatggaaagaag

SEQ ID NO: 2516 - DNA, 48 bp, Artificial Sequence; identical to SEQ ID NO: 2057
  Synthetic polynucleotide

SEQ ID NO: 2517 - DNA, 48 bp, Artificial Sequence; identical to SEQ ID NO: 2058
  Synthetic polynucleotide

SEQ ID NO: 2518 - DNA, 48 bp, Artificial Sequence; identical to SEQ ID NO: 2059
  Synthetic polynucleotide

SEQ ID NO: 2519 - DNA, 32 bp, Artificial Sequence; identical to SEQ ID NO: 2060
  Synthetic polynucleotide

SEQ ID NO: 2520 - DNA, 48 bp, Artificial Sequence; identical to SEQ ID NO: 2061
  Synthetic polynucleotide

SEQ ID NO: 2521 - DNA, 32 bp, Artificial Sequence; identical to SEQ ID NO: 2062
  Synthetic polynucleotide

SEQ ID NO: 2522 - DNA, 48 bp, Artificial Sequence; identical to SEQ ID NO: 2063
  Synthetic polynucleotide

SEQ ID NO: 2523 - DNA, 32 bp, Artificial Sequence; identical to SEQ ID NO: 2064
  Synthetic polynucleotide

SEQ ID NO: 2524 - DNA, 48 bp, Artificial Sequence; identical to SEQ ID NO: 2065
  Synthetic polynucleotide

SEQ ID NO: 2525 - DNA, 32 bp, Artificial Sequence; identical to SEQ ID NO: 2066
  Synthetic polynucleotide

SEQ ID NO: 2526 - DNA, 48 bp, Artificial Sequence; identical to SEQ ID NO: 2067
  Synthetic polynucleotide

SEQ ID NO: 2527 - DNA, 32 bp, Artificial Sequence; identical to SEQ ID NO: 2068
  Synthetic polynucleotide

SEQ ID NO: 2528 - DNA, 32 bp, Artificial Sequence; identical to SEQ ID NO: 2069
  Synthetic polynucleotide

SEQ ID NO: 2529 - DNA, 32 bp, Artificial Sequence; identical to SEQ ID NO: 2070
  Synthetic polynucleotide

SEQ ID NO: 2530 - DNA, 32 bp, Artificial Sequence; identical to SEQ ID NO: 2071
  Synthetic polynucleotide

SEQ ID NO: 2531 - DNA, 32 bp, Artificial Sequence; identical to SEQ ID NO: 2072
  Synthetic polynucleotide

SEQ ID NO: 2532 - DNA, 32 bp, Artificial Sequence; identical to SEQ ID NO: 2073
  Synthetic polynucleotide

SEQ ID NO: 2533 - DNA, 32 bp, Artificial Sequence; identical to SEQ ID NO: 2074
  Synthetic polynucleotide

SEQ ID NO: 2534 - DNA, 32 bp, Artificial Sequence; identical to SEQ ID NO: 2075
  Synthetic polynucleotide

SEQ ID NO: 2535 - DNA, 32 bp, Artificial Sequence; identical to SEQ ID NO: 2076
  Synthetic polynucleotide

SEQ ID NO: 2536 - DNA, 48 bp, Artificial Sequence; identical to SEQ ID NO: 2077
  Synthetic polynucleotide

SEQ ID NO: 2537 - DNA, 48 bp, Artificial Sequence; identical to SEQ ID NO: 2078
  Synthetic polynucleotide

SEQ ID NO: 2538 - DNA, 48 bp, Artificial Sequence; identical to SEQ ID NO: 2079
  Synthetic polynucleotide

SEQ ID NO: 2539 - DNA, 48 bp, Artificial Sequence; identical to SEQ ID NO: 2080
  Synthetic polynucleotide

SEQ ID NO: 2540 - DNA, 16 bp, Artificial Sequence
  Synthetic polynucleotide
aagcatcgcgtccttg

SEQ ID NO: 2541 - DNA, 32 bp, Artificial Sequence; identical to SEQ ID NO: 2082
  Synthetic polynucleotide

SEQ ID NO: 2542 - DNA, 48 bp, Artificial Sequence; identical to SEQ ID NO: 2083
  Synthetic polynucleotide

SEQ ID NO: 2543 - DNA, 32 bp, Artificial Sequence; identical to SEQ ID NO: 2084
  Synthetic polynucleotide

SEQ ID NO: 2544 - DNA, 48 bp, Artificial Sequence; identical to SEQ ID NO: 2085
  Synthetic polynucleotide

SEQ ID NO: 2545 - DNA, 32 bp, Artificial Sequence; identical to SEQ ID NO: 2086
  Synthetic polynucleotide

SEQ ID NO: 2546 - DNA, 48 bp, Artificial Sequence; identical to SEQ ID NO: 2087
  Synthetic polynucleotide

SEQ ID NO: 2547 - DNA, 32 bp, Artificial Sequence; identical to SEQ ID NO: 2088
  Synthetic polynucleotide

SEQ ID NO: 2548 - DNA, 32 bp, Artificial Sequence; identical to SEQ ID NO: 2089
  Synthetic polynucleotide

SEQ ID NO: 2549 - DNA, 32 bp, Artificial Sequence; identical to SEQ ID NO: 2090
  Synthetic polynucleotide

SEQ ID NO: 2550 - DNA, 32 bp, Artificial Sequence; identical to SEQ ID NO: 2091
  Synthetic polynucleotide

SEQ ID NO: 2551 - DNA, 32 bp, Artificial Sequence; identical to SEQ ID NO: 2092
  Synthetic polynucleotide

SEQ ID NO: 2552 - DNA, 32 bp, Artificial Sequence; identical to SEQ ID NO: 2093
  Synthetic polynucleotide

SEQ ID NO: 2553 - DNA, 32 bp, Artificial Sequence; identical to SEQ ID NO: 2094
  Synthetic polynucleotide

SEQ ID NO: 2554 - DNA, 32 bp, Artificial Sequence; identical to SEQ ID NO: 2095
  Synthetic polynucleotide

SEQ ID NO: 2555 - DNA, 32 bp, Artificial Sequence; identical to SEQ ID NO: 2096
  Synthetic polynucleotide

SEQ ID NO: 2556 - DNA, 32 bp, Artificial Sequence; identical to SEQ ID NO: 2097
  Synthetic polynucleotide

SEQ ID NO: 2557 - DNA, 16 bp, Artificial Sequence
  Synthetic polynucleotide
taagacaagtagaaca

SEQ ID NO: 2558 - DNA, 48 bp, Artificial Sequence; identical to SEQ ID NO: 2099
  Synthetic polynucleotide

SEQ ID NO: 2559 - DNA, 48 bp, Artificial Sequence; identical to SEQ ID NO: 2100
  Synthetic polynucleotide

SEQ ID NO: 2560 - DNA, 48 bp, Artificial Sequence; identical to SEQ ID NO: 2101
  Synthetic polynucleotide

SEQ ID NO: 2561 - DNA, 32 bp, Artificial Sequence; identical to SEQ ID NO: 2102
  Synthetic polynucleotide

SEQ ID NO: 2562 - DNA, 48 bp, Artificial Sequence
  Synthetic polynucleotide
ctatcttcataggacacaacagttaaccgtgagtatgatttttttttt

SEQ ID NO: 2563 - DNA, 48 bp, Artificial Sequence; identical to SEQ ID NO: 2105
  Synthetic polynucleotide

SEQ ID NO: 2564 - DNA, 48 bp, Artificial Sequence; identical to SEQ ID NO: 2106
  Synthetic polynucleotide

SEQ ID NO: 2565 - DNA, 48 bp, Artificial Sequence; identical to SEQ ID NO: 2107
  Synthetic polynucleotide

SEQ ID NO: 2566 - DNA, 32 bp, Artificial Sequence
  Synthetic polynucleotide
ttttttttgagccacttaacctggccatccct

SEQ ID NO: 2567 - DNA, 48 bp, Artificial Sequence
  Synthetic polynucleotide
gagggaacgtgcgttgagttcgtacagtctctggggtcactttttttt

SEQ ID NO: 2568 - DNA, 48 bp, Artificial Sequence; identical to SEQ ID NO: 2110
  Synthetic polynucleotide

SEQ ID NO: 2569 - DNA, 48 bp, Artificial Sequence; identical to SEQ ID NO: 2111
  Synthetic polynucleotide

SEQ ID NO: 2570 - DNA, 48 bp, Artificial Sequence; identical to SEQ ID NO: 2112
  Synthetic polynucleotide

SEQ ID NO: 2571 - DNA, 32 bp, Artificial Sequence
  Synthetic polynucleotide
ttttttttggcttcattagcccggctcccggt

SEQ ID NO: 2572 - DNA, 48 bp, Artificial Sequence
  Synthetic polynucleotide
agcttgggacagctaagtggctgggcttgaacgagtcggctttttttt

SEQ ID NO: 2573 - DNA, 48 bp, Artificial Sequence; identical to SEQ ID NO: 2115
  Synthetic polynucleotide

SEQ ID NO: 2574 - DNA, 48 bp, Artificial Sequence; identical to SEQ ID NO: 2116
  Synthetic polynucleotide

SEQ ID NO: 2575 - DNA, 48 bp, Artificial Sequence; identical to SEQ ID NO: 2117
  Synthetic polynucleotide

SEQ ID NO: 2576 - DNA, 32 bp, Artificial Sequence
  Synthetic polynucleotide
ttttttttagttttggcaccagaatgcgagat

SEQ ID NO: 2577 - DNA, 32 bp, Artificial Sequence
  Synthetic polynucleotide
cacgcgagggaaggacctttaggctttttttt

SEQ ID NO: 2578 - DNA, 48 bp, Artificial Sequence; identical to SEQ ID NO: 2120
  Synthetic polynucleotide

SEQ ID NO: 2579 - DNA, 32 bp, Artificial Sequence; identical to SEQ ID NO: 2121
  Synthetic polynucleotide

SEQ ID NO: 2580 - DNA, 48 bp, Artificial Sequence; identical to SEQ ID NO: 2122
  Synthetic polynucleotide

SEQ ID NO: 2581 - DNA, 32 bp, Artificial Sequence; identical to SEQ ID NO: 2123
  Synthetic polynucleotide

SEQ ID NO: 2582 - DNA, 48 bp, Artificial Sequence; identical to SEQ ID NO: 2124
  Synthetic polynucleotide

SEQ ID NO: 2583 - DNA, 32 bp, Artificial Sequence; identical to SEQ ID NO: 2125
  Synthetic polynucleotide

SEQ ID NO: 2584 - DNA, 32 bp, Artificial Sequence; identical to SEQ ID NO: 2126
  Synthetic polynucleotide

SEQ ID NO: 2585 - DNA, 32 bp, Artificial Sequence
  Synthetic polynucleotide
ttttttttcacccccgattaccgttgggtaag

SEQ ID NO: 2586 - DNA, 32 bp, Artificial Sequence
  Synthetic polynucleotide
aattctcaccaaggaggccggagttttttttt

SEQ ID NO: 2587 - DNA, 48 bp, Artificial Sequence; identical to SEQ ID NO: 2129
  Synthetic polynucleotide

SEQ ID NO: 2588 - DNA, 32 bp, Artificial Sequence; identical to SEQ ID NO: 2130
  Synthetic polynucleotide

SEQ ID NO: 2589 - DNA, 48 bp, Artificial Sequence; identical to SEQ ID NO: 2131
  Synthetic polynucleotide

SEQ ID NO: 2590 - DNA, 32 bp, Artificial Sequence; identical to SEQ ID NO: 2132
  Synthetic polynucleotide

SEQ ID NO: 2591 - DNA, 48 bp, Artificial Sequence; identical to SEQ ID NO: 2133
  Synthetic polynucleotide

SEQ ID NO: 2592 - DNA, 32 bp, Artificial Sequence; identical to SEQ ID NO: 2134
  Synthetic polynucleotide

SEQ ID NO: 2593 - DNA, 32 bp, Artificial Sequence; identical to SEQ ID NO: 2135
  Synthetic polynucleotide

SEQ ID NO: 2594 - DNA, 32 bp, Artificial Sequence
  Synthetic polynucleotide
ttttttttggatatcgggcgcatatgagcttt

SEQ ID NO: 2595 - DNA, 32 bp, Artificial Sequence
  Synthetic polynucleotide
cggaacaggccccctagtttgaactttttttt

SEQ ID NO: 2596 - DNA, 48 bp, Artificial Sequence; identical to SEQ ID NO: 2138
  Synthetic polynucleotide

SEQ ID NO: 2597 - DNA, 32 bp, Artificial Sequence; identical to SEQ ID NO: 2139
  Synthetic polynucleotide

SEQ ID NO: 2598 - DNA, 48 bp, Artificial Sequence; identical to SEQ ID NO: 2140
  Synthetic polynucleotide

SEQ ID NO: 2599 - DNA, 32 bp, Artificial Sequence; identical to SEQ ID NO: 2141
  Synthetic polynucleotide

SEQ ID NO: 2600 - DNA, 48 bp, Artificial Sequence; identical to SEQ ID NO: 2142
  Synthetic polynucleotide

SEQ ID NO: 2601 - DNA, 32 bp, Artificial Sequence; identical to SEQ ID NO: 2143
  Synthetic polynucleotide

SEQ ID NO: 2602 - DNA, 32 bp, Artificial Sequence; identical to SEQ ID NO: 2144
  Synthetic polynucleotide

SEQ ID NO: 2603 - DNA, 32 bp, Artificial Sequence
  Synthetic polynucleotide
tttttttttgataatcctcgtgcttcgagaaa

SEQ ID NO: 2604 - DNA, 32 bp, Artificial Sequence
  Synthetic polynucleotide
cttgacgagtataaccgaggcggctttttttt

SEQ ID NO: 2605 - DNA, 32 bp, Artificial Sequence; identical to SEQ ID NO: 2147
  Synthetic polynucleotide

SEQ ID NO: 2606 - DNA, 32 bp, Artificial Sequence; identical to SEQ ID NO: 2148
  Synthetic polynucleotide

SEQ ID NO: 2607 - DNA, 32 bp, Artificial Sequence; identical to SEQ ID NO: 2149
  Synthetic polynucleotide

SEQ ID NO: 2608 - DNA, 32 bp, Artificial Sequence; identical to SEQ ID NO: 2150
  Synthetic polynucleotide

SEQ ID NO: 2609 - DNA, 32 bp, Artificial Sequence; identical to SEQ ID NO: 2151
  Synthetic polynucleotide

SEQ ID NO: 2610 - DNA, 32 bp, Artificial Sequence; identical to SEQ ID NO: 2152
  Synthetic polynucleotide

SEQ ID NO: 2611 - DNA, 32 bp, Artificial Sequence; identical to SEQ ID NO: 2153
  Synthetic polynucleotide

SEQ ID NO: 2612 - DNA, 32 bp, Artificial Sequence
  Synthetic polynucleotide
tttttttttgccgagggggcactcatcgggtt

SEQ ID NO: 2613 - DNA, 32 bp, Artificial Sequence
  Synthetic polynucleotide
aatgcacagcgcgcctcaggctactttttttt

SEQ ID NO: 2614 - DNA, 32 bp, Artificial Sequence; identical to SEQ ID NO: 2156
  Synthetic polynucleotide

SEQ ID NO: 2615 - DNA, 32 bp, Artificial Sequence; identical to SEQ ID NO: 2157
  Synthetic polynucleotide

SEQ ID NO: 2616 - DNA, 32 bp, Artificial Sequence; identical to SEQ ID NO: 2158
  Synthetic polynucleotide

SEQ ID NO: 2617 - DNA, 32 bp, Artificial Sequence; identical to SEQ ID NO: 2159
  Synthetic polynucleotide

SEQ ID NO: 2618 - DNA, 32 bp, Artificial Sequence; identical to SEQ ID NO: 2160
  Synthetic polynucleotide

SEQ ID NO: 2619 - DNA, 32 bp, Artificial Sequence; identical to SEQ ID NO: 2161
  Synthetic polynucleotide

SEQ ID NO: 2620 - DNA, 32 bp, Artificial Sequence; identical to SEQ ID NO: 2162
  Synthetic polynucleotide

SEQ ID NO: 2621 - DNA, 32 bp, Artificial Sequence
  Synthetic polynucleotide
ttttttttagctttattgcccatggtgacacg

SEQ ID NO: 2622 - DNA, 32 bp, Artificial Sequence
  Synthetic polynucleotide
atatcaagattgaaaggtgtcaagtttttttt

SEQ ID NO: 2623 - DNA, 32 bp, Artificial Sequence; identical to SEQ ID NO: 2165
  Synthetic polynucleotide

SEQ ID NO: 2624 - DNA, 32 bp, Artificial Sequence; identical to SEQ ID NO: 2166
  Synthetic polynucleotide

SEQ ID NO: 2625 - DNA, 32 bp, Artificial Sequence; identical to SEQ ID NO: 2167
  Synthetic polynucleotide

SEQ ID NO: 2626 - DNA, 32 bp, Artificial Sequence; identical to SEQ ID NO: 2168
  Synthetic polynucleotide

SEQ ID NO: 2627 - DNA, 32 bp, Artificial Sequence; identical to SEQ ID NO: 2169
  Synthetic polynucleotide

SEQ ID NO: 2628 - DNA, 32 bp, Artificial Sequence; identical to SEQ ID NO: 2170
  Synthetic polynucleotide

SEQ ID NO: 2629 - DNA, 32 bp, Artificial Sequence; identical to SEQ ID NO: 2171
  Synthetic polynucleotide

SEQ ID NO: 2630 - DNA, 32 bp, Artificial Sequence
  Synthetic polynucleotide
ttttttttgaggatgttggtggtttctagcag

SEQ ID NO: 2631 - DNA, 32 bp, Artificial Sequence
  Synthetic polynucleotide
actttctgacaccggccgtcttaatttttttt

SEQ ID NO: 2632 - DNA, 32 bp, Artificial Sequence; identical to SEQ ID NO: 2174
  Synthetic polynucleotide

SEQ ID NO: 2633 - DNA, 32 bp, Artificial Sequence; identical to SEQ ID NO: 2175
  Synthetic polynucleotide

SEQ ID NO: 2634 - DNA, 32 bp, Artificial Sequence; identical to SEQ ID NO: 2176
  Synthetic polynucleotide

SEQ ID NO: 2635 - DNA, 32 bp, Artificial Sequence; identical to SEQ ID NO: 2177
  Synthetic polynucleotide

SEQ ID NO: 2636 - DNA, 32 bp, Artificial Sequence; identical to SEQ ID NO: 2178
  Synthetic polynucleotide

SEQ ID NO: 2637 - DNA, 32 bp, Artificial Sequence; identical to SEQ ID NO: 2179
  Synthetic polynucleotide

SEQ ID NO: 2638 - DNA, 32 bp, Artificial Sequence; identical to SEQ ID NO: 2180
  Synthetic polynucleotide

SEQ ID NO: 2639 - DNA, 32 bp, Artificial Sequence
  Synthetic polynucleotide
ttttttttacgactttatgtggttccattacg

SEQ ID NO: 2640 - DNA, 32 bp, Artificial Sequence
  Synthetic polynucleotide
agcctacgtgactaccggaggcggtttttttt

SEQ ID NO: 2641 - DNA, 32 bp, Artificial Sequence; identical to SEQ ID NO: 2183
  Synthetic polynucleotide

SEQ ID NO: 2642 - DNA, 32 bp, Artificial Sequence; identical to SEQ ID NO: 2184
  Synthetic polynucleotide

SEQ ID NO: 2643 - DNA, 32 bp, Artificial Sequence; identical to SEQ ID NO: 2185
  Synthetic polynucleotide

SEQ ID NO: 2644 - DNA, 32 bp, Artificial Sequence; identical to SEQ ID NO: 2186
  Synthetic polynucleotide

SEQ ID NO: 2645 - DNA, 32 bp, Artificial Sequence; identical to SEQ ID NO: 2187
  Synthetic polynucleotide

SEQ ID NO: 2646 - DNA, 32 bp, Artificial Sequence; identical to SEQ ID NO: 2188
  Synthetic polynucleotide

SEQ ID NO: 2647 - DNA, 32 bp, Artificial Sequence; identical to SEQ ID NO: 2189
  Synthetic polynucleotide

SEQ ID NO: 2648 - DNA, 32 bp, Artificial Sequence
  Synthetic polynucleotide
tttttttttctcataattccttttaggtctac

SEQ ID NO: 2649 - DNA, 32 bp, Artificial Sequence
  Synthetic polynucleotide
ggtaggttttaggatcccacatgatttttttt

SEQ ID NO: 2650 - DNA, 32 bp, Artificial Sequence; identical to SEQ ID NO: 2192
  Synthetic polynucleotide

SEQ ID NO: 2651 - DNA, 32 bp, Artificial Sequence; identical to SEQ ID NO: 2193
  Synthetic polynucleotide

SEQ ID NO: 2652 - DNA, 32 bp, Artificial Sequence; identical to SEQ ID NO: 2194
  Synthetic polynucleotide

SEQ ID NO: 2653 - DNA, 32 bp, Artificial Sequence; identical to SEQ ID NO: 2195
  Synthetic polynucleotide

SEQ ID NO: 2654 - DNA, 32 bp, Artificial Sequence; identical to SEQ ID NO: 2196
  Synthetic polynucleotide

SEQ ID NO: 2655 - DNA, 32 bp, Artificial Sequence; identical to SEQ ID NO: 2197
  Synthetic polynucleotide

SEQ ID NO: 2656 - DNA, 32 bp, Artificial Sequence; identical to SEQ ID NO: 2198
  Synthetic polynucleotide

SEQ ID NO: 2657 - DNA, 32 bp, Artificial Sequence
  Synthetic polynucleotide
ttttttttgtcttgcgtcaagctgtctgcaac

SEQ ID NO: 2658 - DNA, 32 bp, Artificial Sequence
  Synthetic polynucleotide
cgtacgcacgcgagcaaacggcgatttttttt

SEQ ID NO: 2659 - DNA, 32 bp, Artificial Sequence; identical to SEQ ID NO: 2201
  Synthetic polynucleotide

SEQ ID NO: 2660 - DNA, 32 bp, Artificial Sequence; identical to SEQ ID NO: 2202
  Synthetic polynucleotide

SEQ ID NO: 2661 - DNA, 32 bp, Artificial Sequence; identical to SEQ ID NO: 2203
  Synthetic polynucleotide

SEQ ID NO: 2662 - DNA, 32 bp, Artificial Sequence; identical to SEQ ID NO: 2204
  Synthetic polynucleotide

SEQ ID NO: 2663 - DNA, 32 bp, Artificial Sequence; identical to SEQ ID NO: 2205
  Synthetic polynucleotide

SEQ ID NO: 2664 - DNA, 32 bp, Artificial Sequence; identical to SEQ ID NO: 2206
  Synthetic polynucleotide

SEQ ID NO: 2665 - DNA, 32 bp, Artificial Sequence; identical to SEQ ID NO: 2207
  Synthetic polynucleotide

SEQ ID NO: 2666 - DNA, 32 bp, Artificial Sequence
  Synthetic polynucleotide
ttttttttcatcgccgccatgaaagtccggtc

SEQ ID NO: 2667 - DNA, 32 bp, Artificial Sequence
  Synthetic polynucleotide
acggggttgttaatgcagttactgtttttttt

SEQ ID NO: 2668 - DNA, 32 bp, Artificial Sequence; identical to SEQ ID NO: 2210
  Synthetic polynucleotide

SEQ ID NO: 2669 - DNA, 32 bp, Artificial Sequence; identical to SEQ ID NO: 2211
  Synthetic polynucleotide

SEQ ID NO: 2670 - DNA, 32 bp, Artificial Sequence; identical to SEQ ID NO: 2212
  Synthetic polynucleotide

SEQ ID NO: 2671 - DNA, 32 bp, Artificial Sequence; identical to SEQ ID NO: 2213
  Synthetic polynucleotide

SEQ ID NO: 2672 - DNA, 32 bp, Artificial Sequence; identical to SEQ ID NO: 2214
  Synthetic polynucleotide

SEQ ID NO: 2673 - DNA, 32 bp, Artificial Sequence; identical to SEQ ID NO: 2215
  Synthetic polynucleotide

SEQ ID NO: 2674 - DNA, 32 bp, Artificial Sequence; identical to SEQ ID NO: 2216
  Synthetic polynucleotide

SEQ ID NO: 2675 - DNA, 32 bp, Artificial Sequence
  Synthetic polynucleotide
tttttttttccagaatgcagtccgatgttggg

SEQ ID NO: 2676 - DNA, 32 bp, Artificial Sequence
  Synthetic polynucleotide
cgtcactttttaaaccaattcatatttttttt

SEQ ID NO: 2677 - DNA, 32 bp, Artificial Sequence; identical to SEQ ID NO: 2219
  Synthetic polynucleotide

SEQ ID NO: 2678 - DNA, 32 bp, Artificial Sequence; identical to SEQ ID NO: 2220
  Synthetic polynucleotide

SEQ ID NO: 2679 - DNA, 32 bp, Artificial Sequence; identical to SEQ ID NO: 2221
  Synthetic polynucleotide

SEQ ID NO: 2680 - DNA, 32 bp, Artificial Sequence; identical to SEQ ID NO: 2222
  Synthetic polynucleotide

SEQ ID NO: 2681 - DNA, 32 bp, Artificial Sequence; identical to SEQ ID NO: 2223
  Synthetic polynucleotide

SEQ ID NO: 2682 - DNA, 32 bp, Artificial Sequence; identical to SEQ ID NO: 2224
  Synthetic polynucleotide

SEQ ID NO: 2683 - DNA, 32 bp, Artificial Sequence; identical to SEQ ID NO: 2225
  Synthetic polynucleotide

SEQ ID NO: 2684 - DNA, 32 bp, Artificial Sequence
  Synthetic polynucleotide
ttttttttcgtagttcgcctgtgagctattcg

SEQ ID NO: 2685 - DNA, 32 bp, Artificial Sequence
  Synthetic polynucleotide
cccgagtcagacctgtaccgaagctttttttt

SEQ ID NO: 2686 - DNA, 32 bp, Artificial Sequence; identical to SEQ ID NO: 2228
  Synthetic polynucleotide

SEQ ID NO: 2687 - DNA, 32 bp, Artificial Sequence; identical to SEQ ID NO: 2229
  Synthetic polynucleotide

SEQ ID NO: 2688 - DNA, 32 bp, Artificial Sequence; identical to SEQ ID NO: 2230
  Synthetic polynucleotide

SEQ ID NO: 2689 - DNA, 32 bp, Artificial Sequence; identical to SEQ ID NO: 2231
  Synthetic polynucleotide

SEQ ID NO: 2690 - DNA, 32 bp, Artificial Sequence; identical to SEQ ID NO: 2232
  Synthetic polynucleotide

SEQ ID NO: 2691 - DNA, 32 bp, Artificial Sequence; identical to SEQ ID NO: 2233
  Synthetic polynucleotide

SEQ ID NO: 2692 - DNA, 32 bp, Artificial Sequence; identical to SEQ ID NO: 2234
  Synthetic polynucleotide

SEQ ID NO: 2693 - DNA, 32 bp, Artificial Sequence
  Synthetic polynucleotide
ttttttttggtgatctaccagttccacaaggg

SEQ ID NO: 2694 - DNA, 32 bp, Artificial Sequence
  Synthetic polynucleotide
tctgatggtgctgggtacactaattttttttt

SEQ ID NO: 2695 - DNA, 32 bp, Artificial Sequence; identical to SEQ ID NO: 2237
  Synthetic polynucleotide

SEQ ID NO: 2696 - DNA, 32 bp, Artificial Sequence; identical to SEQ ID NO: 2238
  Synthetic polynucleotide

SEQ ID NO: 2697 - DNA, 32 bp, Artificial Sequence; identical to SEQ ID NO: 2239
  Synthetic polynucleotide

SEQ ID NO: 2698 - DNA, 32 bp, Artificial Sequence; identical to SEQ ID NO: 2240
  Synthetic polynucleotide

SEQ ID NO: 2699 - DNA, 32 bp, Artificial Sequence; identical to SEQ ID NO: 2241
  Synthetic polynucleotide

SEQ ID NO: 2700 - DNA, 32 bp, Artificial Sequence; identical to SEQ ID NO: 2242
  Synthetic polynucleotide

SEQ ID NO: 2701 - DNA, 32 bp, Artificial Sequence; identical to SEQ ID NO: 2243
  Synthetic polynucleotide

SEQ ID NO: 2702 - DNA, 32 bp, Artificial Sequence
  Synthetic polynucleotide
ttttttttctaagccgccgtaatcacggtatt

SEQ ID NO: 2703 - DNA, 32 bp, Artificial Sequence
  Synthetic polynucleotide
gaaaactgcttgtactcaattccctttttttt

SEQ ID NO: 2704 - DNA, 32 bp, Artificial Sequence; identical to SEQ ID NO: 2246
  Synthetic polynucleotide

SEQ ID NO: 2705 - DNA, 32 bp, Artificial Sequence; identical to SEQ ID NO: 2247
  Synthetic polynucleotide

SEQ ID NO: 2706 - DNA, 32 bp, Artificial Sequence; identical to SEQ ID NO: 2248
  Synthetic polynucleotide

SEQ ID NO: 2707 - DNA, 32 bp, Artificial Sequence; identical to SEQ ID NO: 2249
  Synthetic polynucleotide

SEQ ID NO: 2708 - DNA, 32 bp, Artificial Sequence; identical to SEQ ID NO: 2250
  Synthetic polynucleotide

SEQ ID NO: 2709 - DNA, 32 bp, Artificial Sequence; identical to SEQ ID NO: 2251
  Synthetic polynucleotide

SEQ ID NO: 2710 - DNA, 32 bp, Artificial Sequence; identical to SEQ ID NO: 2252
  Synthetic polynucleotide

SEQ ID NO: 2711 - DNA, 32 bp, Artificial Sequence
  Synthetic polynucleotide
ttttttttaccctaacaggaggtggggtgacc

SEQ ID NO: 2712 - DNA, 32 bp, Artificial Sequence
  Synthetic polynucleotide
accattgtgtcgaattcgctgatctttttttt

SEQ ID NO: 2713 - DNA, 32 bp, Artificial Sequence; identical to SEQ ID NO: 2255
  Synthetic polynucleotide

SEQ ID NO: 2714 - DNA, 32 bp, Artificial Sequence; identical to SEQ ID NO: 2256
  Synthetic polynucleotide

SEQ ID NO: 2715 - DNA, 32 bp, Artificial Sequence; identical to SEQ ID NO: 2257
  Synthetic polynucleotide

SEQ ID NO: 2716 - DNA, 32 bp, Artificial Sequence; identical to SEQ ID NO: 2258
  Synthetic polynucleotide

SEQ ID NO: 2717 - DNA, 32 bp, Artificial Sequence; identical to SEQ ID NO: 2259
  Synthetic polynucleotide

SEQ ID NO: 2718 - DNA, 32 bp, Artificial Sequence; identical to SEQ ID NO: 2260
  Synthetic polynucleotide

SEQ ID NO: 2719 - DNA, 32 bp, Artificial Sequence; identical to SEQ ID NO: 2261
  Synthetic polynucleotide

SEQ ID NO: 2720 - DNA, 32 bp, Artificial Sequence
  Synthetic polynucleotide
ttttttttcgcggacattatattacggtttac

SEQ ID NO: 2721 - DNA, 32 bp, Artificial Sequence
  Synthetic polynucleotide
caggcaaggaggttagcctaggcgtttttttt

SEQ ID NO: 2722 - DNA, 32 bp, Artificial Sequence; identical to SEQ ID NO: 2264
  Synthetic polynucleotide

SEQ ID NO: 2723 - DNA, 32 bp, Artificial Sequence; identical to SEQ ID NO: 2265
  Synthetic polynucleotide

SEQ ID NO: 2724 - DNA, 32 bp, Artificial Sequence; identical to SEQ ID NO: 2266
  Synthetic polynucleotide

SEQ ID NO: 2725 - DNA, 32 bp, Artificial Sequence; identical to SEQ ID NO: 2267
  Synthetic polynucleotide

SEQ ID NO: 2726 - DNA, 32 bp, Artificial Sequence; identical to SEQ ID NO: 2268
  Synthetic polynucleotide

SEQ ID NO: 2727 - DNA, 32 bp, Artificial Sequence; identical to SEQ ID NO: 2269
  Synthetic polynucleotide

SEQ ID NO: 2728 - DNA, 32 bp, Artificial Sequence; identical to SEQ ID NO: 2270
  Synthetic polynucleotide

SEQ ID NO: 2729 - DNA, 32 bp, Artificial Sequence
  Synthetic polynucleotide
ttttttttatcacatagaccacgtcctctcct

SEQ ID NO: 2730 - DNA, 32 bp, Artificial Sequence
  Synthetic polynucleotide
gagctcacatgctgggtgtaccattttttttt

SEQ ID NO: 2731 - DNA, 32 bp, Artificial Sequence; identical to SEQ ID NO: 2273
  Synthetic polynucleotide

SEQ ID NO: 2732 - DNA, 32 bp, Artificial Sequence; identical to SEQ ID NO: 2274
  Synthetic polynucleotide

SEQ ID NO: 2733 - DNA, 32 bp, Artificial Sequence; identical to SEQ ID NO: 2275
  Synthetic polynucleotide

SEQ ID NO: 2734 - DNA, 32 bp, Artificial Sequence; identical to SEQ ID NO: 2276
  Synthetic polynucleotide

SEQ ID NO: 2735 - DNA, 32 bp, Artificial Sequence; identical to SEQ ID NO: 2277
  Synthetic polynucleotide

SEQ ID NO: 2736 - DNA, 32 bp, Artificial Sequence; identical to SEQ ID NO: 2278
  Synthetic polynucleotide

SEQ ID NO: 2737 - DNA, 32 bp, Artificial Sequence; identical to SEQ ID NO: 2279
  Synthetic polynucleotide

SEQ ID NO: 2738 - DNA, 32 bp, Artificial Sequence
  Synthetic polynucleotide
ttttttttccccgctccctagaacactcgccg

SEQ ID NO: 2739 - DNA, 32 bp, Artificial Sequence
  Synthetic polynucleotide
tcgtattaggtcggccccaccttatttttttt

SEQ ID NO: 2740 - DNA, 32 bp, Artificial Sequence; identical to SEQ ID NO: 2282
  Synthetic polynucleotide

SEQ ID NO: 2741 - DNA, 32 bp, Artificial Sequence; identical to SEQ ID NO: 2283
  Synthetic polynucleotide

SEQ ID NO: 2742 - DNA, 32 bp, Artificial Sequence; identical to SEQ ID NO: 2284
  Synthetic polynucleotide

SEQ ID NO: 2743 - DNA, 32 bp, Artificial Sequence; identical to SEQ ID NO: 2285
  Synthetic polynucleotide

SEQ ID NO: 2744 - DNA, 32 bp, Artificial Sequence; identical to SEQ ID NO: 2286
  Synthetic polynucleotide

SEQ ID NO: 2745 - DNA, 32 bp, Artificial Sequence; identical to SEQ ID NO: 2287
  Synthetic polynucleotide

SEQ ID NO: 2746 - DNA, 32 bp, Artificial Sequence; identical to SEQ ID NO: 2288
  Synthetic polynucleotide

SEQ ID NO: 2747 - DNA, 32 bp, Artificial Sequence
  Synthetic polynucleotide
tttttttttagcgccttggtcggtcgcattca

SEQ ID NO: 2748 - DNA, 32 bp, Artificial Sequence
  Synthetic polynucleotide
gcatgagattacgagtataccctatttttttt

SEQ ID NO: 2749 - DNA, 32 bp, Artificial Sequence; identical to SEQ ID NO: 2291
  Synthetic polynucleotide

SEQ ID NO: 2750 - DNA, 32 bp, Artificial Sequence; identical to SEQ ID NO: 2292
  Synthetic polynucleotide

SEQ ID NO: 2751 - DNA, 32 bp, Artificial Sequence; identical to SEQ ID NO: 2293
  Synthetic polynucleotide

SEQ ID NO: 2752 - DNA, 32 bp, Artificial Sequence; identical to SEQ ID NO: 2294
  Synthetic polynucleotide

SEQ ID NO: 2753 - DNA, 32 bp, Artificial Sequence; identical to SEQ ID NO: 2295
  Synthetic polynucleotide

SEQ ID NO: 2754 - DNA, 32 bp, Artificial Sequence; identical to SEQ ID NO: 2296
  Synthetic polynucleotide

SEQ ID NO: 2755 - DNA, 32 bp, Artificial Sequence; identical to SEQ ID NO: 2297
  Synthetic polynucleotide

SEQ ID NO: 2756 - DNA, 32 bp, Artificial Sequence
  Synthetic polynucleotide
ttttttttctacaacttattgaagaagcgggt

SEQ ID NO: 2757 - DNA, 32 bp, Artificial Sequence
  Synthetic polynucleotide
cgtgggacacctgccagctgatgctttttttt

SEQ ID NO: 2758 - DNA, 32 bp, Artificial Sequence; identical to SEQ ID NO: 2300
  Synthetic polynucleotide

SEQ ID NO: 2759 - DNA, 32 bp, Artificial Sequence; identical to SEQ ID NO: 2301
  Synthetic polynucleotide

SEQ ID NO: 2760 - DNA, 32 bp, Artificial Sequence; identical to SEQ ID NO: 2302
  Synthetic polynucleotide

SEQ ID NO: 2761 - DNA, 32 bp, Artificial Sequence; identical to SEQ ID NO: 2303
  Synthetic polynucleotide

SEQ ID NO: 2762 - DNA, 32 bp, Artificial Sequence; identical to SEQ ID NO: 2304
  Synthetic polynucleotide

SEQ ID NO: 2763 - DNA, 32 bp, Artificial Sequence; identical to SEQ ID NO: 2305
  Synthetic polynucleotide

SEQ ID NO: 2764 - DNA, 32 bp, Artificial Sequence; identical to SEQ ID NO: 2306
  Synthetic polynucleotide

SEQ ID NO: 2765 - DNA, 32 bp, Artificial Sequence
  Synthetic polynucleotide
ttttttttcttctttccataccgtgcgtagct

SEQ ID NO: 2766 - DNA, 32 bp, Artificial Sequence
  Synthetic polynucleotide
ggggactcttagggtcatcggatttttttttt

SEQ ID NO: 2767 - DNA, 32 bp, Artificial Sequence; identical to SEQ ID NO: 2309
  Synthetic polynucleotide

SEQ ID NO: 2768 - DNA, 48 bp, Artificial Sequence; identical to SEQ ID NO: 2310
  Synthetic polynucleotide

SEQ ID NO: 2769 - DNA, 32 bp, Artificial Sequence; identical to SEQ ID NO: 2311
  Synthetic polynucleotide

SEQ ID NO: 2770 - DNA, 48 bp, Artificial Sequence; identical to SEQ ID NO: 2312
  Synthetic polynucleotide

SEQ ID NO: 2771 - DNA, 32 bp, Artificial Sequence; identical to SEQ ID NO: 2313
  Synthetic polynucleotide

SEQ ID NO: 2772 - DNA, 48 bp, Artificial Sequence; identical to SEQ ID NO: 2314
  Synthetic polynucleotide

SEQ ID NO: 2773 - DNA, 32 bp, Artificial Sequence; identical to SEQ ID NO: 2315
  Synthetic polynucleotide

SEQ ID NO: 2774 - DNA, 32 bp, Artificial Sequence
  Synthetic polynucleotide
ttttttttaggcctcggtgccgtaccggcgga

SEQ ID NO: 2775 - DNA, 32 bp, Artificial Sequence
  Synthetic polynucleotide
cttacttgtgatcaatcggcgccgtttttttt

SEQ ID NO: 2776 - DNA, 32 bp, Artificial Sequence; identical to SEQ ID NO: 2318
  Synthetic polynucleotide

SEQ ID NO: 2777 - DNA, 48 bp, Artificial Sequence; identical to SEQ ID NO: 2319
  Synthetic polynucleotide

SEQ ID NO: 2778 - DNA, 32 bp, Artificial Sequence; identical to SEQ ID NO: 2320
  Synthetic polynucleotide

SEQ ID NO: 2779 - DNA, 48 bp, Artificial Sequence; identical to SEQ ID NO: 2321
  Synthetic polynucleotide

SEQ ID NO: 2780 - DNA, 32 bp, Artificial Sequence; identical to SEQ ID NO: 2322
  Synthetic polynucleotide

SEQ ID NO: 2781 - DNA, 48 bp, Artificial Sequence; identical to SEQ ID NO: 2323
  Synthetic polynucleotide

SEQ ID NO: 2782 - DNA, 32 bp, Artificial Sequence; identical to SEQ ID NO: 2324
  Synthetic polynucleotide

SEQ ID NO: 2783 - DNA, 32 bp, Artificial Sequence
  Synthetic polynucleotide
ttttttttttgcgctttttgcaccacctatac

SEQ ID NO: 2784 - DNA, 32 bp, Artificial Sequence
  Synthetic polynucleotide
taacaaggttgcccttacttggactttttttt

SEQ ID NO: 2785 - DNA, 32 bp, Artificial Sequence; identical to SEQ ID NO: 2327
  Synthetic polynucleotide

SEQ ID NO: 2786 - DNA, 48 bp, Artificial Sequence; identical to SEQ ID NO: 2328
  Synthetic polynucleotide

SEQ ID NO: 2787 - DNA, 32 bp, Artificial Sequence; identical to SEQ ID NO: 2329
  Synthetic polynucleotide

SEQ ID NO: 2788 - DNA, 48 bp, Artificial Sequence; identical to SEQ ID NO: 2330
  Synthetic polynucleotide

SEQ ID NO: 2789 - DNA, 32 bp, Artificial Sequence; identical to SEQ ID NO: 2331
  Synthetic polynucleotide

SEQ ID NO: 2790 - DNA, 48 bp, Artificial Sequence; identical to SEQ ID NO: 2332
  Synthetic polynucleotide

SEQ ID NO: 2791 - DNA, 32 bp, Artificial Sequence; identical to SEQ ID NO: 2333
  Synthetic polynucleotide

SEQ ID NO: 2792 - DNA, 32 bp, Artificial Sequence
  Synthetic polynucleotide
tttttttttgacacccgttgttcctgtccgtg

SEQ ID NO: 2793 - DNA, 32 bp, Artificial Sequence
  Synthetic polynucleotide
acatgaggcaaggacgcgatgctttttttttt

SEQ ID NO: 2794 - DNA, 48 bp, Artificial Sequence; identical to SEQ ID NO: 2335
  Synthetic polynucleotide

SEQ ID NO: 2795 - DNA, 48 bp, Artificial Sequence; identical to SEQ ID NO: 2336
  Synthetic polynucleotide

SEQ ID NO: 2796 - DNA, 48 bp, Artificial Sequence; identical to SEQ ID NO: 2337
  Synthetic polynucleotide

SEQ ID NO: 2797 - DNA, 32 bp, Artificial Sequence; identical to SEQ ID NO: 2338
  Synthetic polynucleotide

SEQ ID NO: 2798 - DNA, 48 bp, Artificial Sequence
  Synthetic polynucleotide
ttttttttccatgcgagcggatgcatataactatattgtatggctggt

SEQ ID NO: 2799 - DNA, 32 bp, Artificial Sequence
  Synthetic polynucleotide
cgaacgcattgccacacatcttaatttttttt

SEQ ID NO: 2800 - DNA, 48 bp, Artificial Sequence; identical to SEQ ID NO: 2341
  Synthetic polynucleotide

SEQ ID NO: 2801 - DNA, 48 bp, Artificial Sequence; identical to SEQ ID NO: 2342
  Synthetic polynucleotide

SEQ ID NO: 2802 - DNA, 48 bp, Artificial Sequence; identical to SEQ ID NO: 2343
  Synthetic polynucleotide

SEQ ID NO: 2803 - DNA, 32 bp, Artificial Sequence; identical to SEQ ID NO: 2344
  Synthetic polynucleotide

SEQ ID NO: 2804 - DNA, 48 bp, Artificial Sequence
  Synthetic polynucleotide
ttttttttcactcccactgtactacgaagtctcatcacggttgcgggg

SEQ ID NO: 2805 - DNA, 32 bp, Artificial Sequence
  Synthetic polynucleotide
taacatcgtgctgtagagcgtgattttttttt

SEQ ID NO: 2806 - DNA, 48 bp, Artificial Sequence; identical to SEQ ID NO: 2347
  Synthetic polynucleotide

SEQ ID NO: 2807 - DNA, 48 bp, Artificial Sequence; identical to SEQ ID NO: 2348
  Synthetic polynucleotide

SEQ ID NO: 2808 - DNA, 48 bp, Artificial Sequence; identical to SEQ ID NO: 2349
  Synthetic polynucleotide

SEQ ID NO: 2809 - DNA, 32 bp, Artificial Sequence; identical to SEQ ID NO: 2350
  Synthetic polynucleotide

SEQ ID NO: 2810 - DNA, 48 bp, Artificial Sequence
  Synthetic polynucleotide
tttttttttgttctacttgtcttagtagttaaatgaatccactacacc

SEQ ID NO: 2811 - DNA, 16 bp, Artificial Sequence
  Synthetic polynucleotide
tggagttatttttttt

SEQ ID NO: 2812 - DNA, 16 bp, Artificial Sequence
  Synthetic polynucleotide
tcctgtcgtttttttt

SEQ ID NO: 2813 - DNA, 16 bp, Artificial Sequence
  Synthetic polynucleotide
ttttttttgggttaga

SEQ ID NO: 2814 - DNA, 48 bp, Artificial Sequence
  Synthetic polynucleotide
atcggattttttttttttttttttacgcttagtcacattagaatatgg

SEQ ID NO: 2815 - DNA, 16 bp, Artificial Sequence
  Synthetic polynucleotide
cgacaggataggtcaa

SEQ ID NO: 2816 - DNA, 16 bp, Artificial Sequence
  Synthetic polynucleotide
accaatgtaagcagat

SEQ ID NO: 2817 - DNA, 16 bp, Artificial Sequence
  Synthetic polynucleotide
aatctttgttatggtg

SEQ ID NO: 2818 - DNA, 48 bp, Artificial Sequence
  Synthetic polynucleotide
taatgtgactaagcgttaactccaaaggaaacccaggttaagtggctc

SEQ ID NO: 2819 - DNA, 48 bp, Artificial Sequence
  Synthetic polynucleotide
tgtttgcttctaacccggctacgagtggtctgagagtctggagatgat

SEQ ID NO: 2820 - DNA, 48 bp, Artificial Sequence
  Synthetic polynucleotide
cagactctcagaccactcgtagccttttttttttttttttatctgctt

SEQ ID NO: 2821 - DNA, 48 bp, Artificial Sequence
  Synthetic polynucleotide
ggctcccgcaccataacaaagattttttttttttttttttaggcctcg

SEQ ID NO: 2822 - DNA, 48 bp, Artificial Sequence
  Synthetic polynucleotide
gagtccccgaagaatatacggcaccgaggcctaatccgatgaccctaa

SEQ ID NO: 2823 - DNA, 48 bp, Artificial Sequence
  Synthetic polynucleotide
gtcaggagttagggtcagcaaacagttccttcatactgtcggaagacc

SEQ ID NO: 2824 - DNA, 48 bp, Artificial Sequence
  Synthetic polynucleotide
cagctatcccatattcgatgtaagcggacatcaataaacgatacttaa

SEQ ID NO: 2825 - DNA, 48 bp, Artificial Sequence
  Synthetic polynucleotide
gacagtatgaaggaaccgggagcctcgggggaaggacttgtagcgatg

SEQ ID NO: 2826 - DNA, 48 bp, Artificial Sequence
  Synthetic polynucleotide
gtttgaacgagccacttaacctgggtttccttacattggtgcatgccg

SEQ ID NO: 2827 - DNA, 48 bp, Artificial Sequence
  Synthetic polynucleotide
cttacttgtgtaaagggatagctgggatatcgggcgcatatgagcttt

SEQ ID NO: 2828 - DNA, 48 bp, Artificial Sequence
  Synthetic polynucleotide
cgtttattgatgtccgcttacatcttgacctagtgccgtatattcttc

SEQ ID NO: 2829 - DNA, 48 bp, Artificial Sequence
  Synthetic polynucleotide
tatgcgcccgatatccgttcaaactagggggcaatcatactcacggtt

SEQ ID NO: 2830 - DNA, 48 bp, Artificial Sequence
  Synthetic polynucleotide
ctccgaaatggaagtgggatctaccggcatgcctcctgaccctttaca

SEQ ID NO: 2831 - DNA, 48 bp, Artificial Sequence
  Synthetic polynucleotide
gcagtcccggtcttccctgcaagaatgcatgagtagggtaccgctggg

SEQ ID NO: 2832 - DNA, 48 bp, Artificial Sequence
  Synthetic polynucleotide
taccctactcatgcattcttgcagatcatctcgtagatcccacttcca

SEQ ID NO: 2833 - DNA, 48 bp, Artificial Sequence
  Synthetic polynucleotide
aactgtaccatcgctacaagtccttcccccgaggggactcccggcgga

SEQ ID NO: 2834 - DNA, 48 bp, Artificial Sequence
  Synthetic polynucleotide
aaaagcagtcaaccggggatattctccgccggcaagtaagcagggcgt

SEQ ID NO: 2835 - DNA, 48 bp, Artificial Sequence
  Synthetic polynucleotide
tgagattaacgccctggggactgcattccatgtaggaaaactaccgat

SEQ ID NO: 2836 - DNA, 48 bp, Artificial Sequence
  Synthetic polynucleotide
ttctgaccaaagctcatgagaattgtaaacagagctctagaggggaac

SEQ ID NO: 2837 - DNA, 48 bp, Artificial Sequence
  Synthetic polynucleotide
ttttcctacatggaatgtacagttcctgacatacaagaagggctatct

SEQ ID NO: 2838 - DNA, 48 bp, Artificial Sequence
  Synthetic polynucleotide
gaacttgaaaccgtgagtatgattgccccctatttcggagtcacctaa

SEQ ID NO: 2839 - DNA, 48 bp, Artificial Sequence
  Synthetic polynucleotide
gtcggaaggttaaaaaggtcagaactgctctaagctgttctccccgtc

SEQ ID NO: 2840 - DNA, 48 bp, Artificial Sequence
  Synthetic polynucleotide
ctagagctctgtttacaattctcattaagtatgaatatccccggttga

SEQ ID NO: 2841 - DNA, 48 bp, Artificial Sequence
  Synthetic polynucleotide
gaacagcttagagcagtcaagttcggatacgcaactgttgtgtcctat

SEQ ID NO: 2842 - DNA, 48 bp, Artificial Sequence
  Synthetic polynucleotide
tgttatatgatatttgaaactactttaggtgataatctcatttttaac

SEQ ID NO: 2843 - DNA, 48 bp, Artificial Sequence
  Synthetic polynucleotide
cacagtcaatcggtaggtgggccttgaggttagttgccctcgaccgat

SEQ ID NO: 2844 - DNA, 48 bp, Artificial Sequence
  Synthetic polynucleotide
agggcaactaacctcaaggcccaccccagcggagtagtttcaaatatc

SEQ ID NO: 2845 - DNA, 48 bp, Artificial Sequence
  Synthetic polynucleotide
gcgaagcttataaaaatgactgtgatcgcggacaaggacatccactgc

SEQ ID NO: 2846 - DNA, 48 bp, Artificial Sequence
  Synthetic polynucleotide
cggacgaaagatagcccttcttgtatgtcaggctgcttttatgccgtt

SEQ ID NO: 2847 - DNA, 48 bp, Artificial Sequence
  Synthetic polynucleotide
tacctatggacggggatatgcgacaccatgatcgtagacttcacataa

SEQ ID NO: 2848 - DNA, 48 bp, Artificial Sequence
  Synthetic polynucleotide
actgctgggtgggcgccgacgagtaacggcatcttccgactttttata

SEQ ID NO: 2849 - DNA, 48 bp, Artificial Sequence
  Synthetic polynucleotide
tgtccttgtccgcgatttcgtccggtgctctacctttgacatggggtt

SEQ ID NO: 2850 - DNA, 48 bp, Artificial Sequence
  Synthetic polynucleotide
tgacgatcataggacacaacagttgcgtatccatataacaacacggtg

SEQ ID NO: 2851 - DNA, 48 bp, Artificial Sequence
  Synthetic polynucleotide
acacagtgagaagattcataggtattcataactcatccggttacttcg

SEQ ID NO: 2852 - DNA, 48 bp, Artificial Sequence
  Synthetic polynucleotide
agtctacgatcatggtgtcgcatagttcccctactcgtcggcgcccac

SEQ ID NO: 2853 - DNA, 48 bp, Artificial Sequence
  Synthetic polynucleotide
ccggatgagttatgaagatcgtcattgggatagtttacttagggatgg

SEQ ID NO: 2854 - DNA, 48 bp, Artificial Sequence
  Synthetic polynucleotide
gctgcctctagggggggggttatacaccgtgtagcttcgcaatcttct

SEQ ID NO: 2855 - DNA, 48 bp, Artificial Sequence
  Synthetic polynucleotide
catttggggcagtggatgcttgctccttgctctagggtgacgtattag

SEQ ID NO: 2856 - DNA, 48 bp, Artificial Sequence
  Synthetic polynucleotide
tcaccctagagcaaggagcaagcaatcggtcgtataacccccccccta

SEQ ID NO: 2857 - DNA, 48 bp, Artificial Sequence
  Synthetic polynucleotide
gatgaaggaaccccatgtcaaaggtagagcacccagcagtccggacgc

SEQ ID NO: 2858 - DNA, 48 bp, Artificial Sequence
  Synthetic polynucleotide
gagcaatagaaattgagagaccaggcgtccggcactgtgtggacgttt

SEQ ID NO: 2859 - DNA, 48 bp, Artificial Sequence
  Synthetic polynucleotide
gactattgaaacgtcccccaaatgcgccagggtaggtatgtgcatatt

SEQ ID NO: 2860 - DNA, 48 bp, Artificial Sequence
  Synthetic polynucleotide
tacaatctcgaagtaaagcatagcaccctgcgaaaacactcggcgagt

SEQ ID NO: 2861 - DNA, 48 bp, Artificial Sequence
  Synthetic polynucleotide
catacctaccctggcgccttcatcacggacttaggactgggtgtaatc

SEQ ID NO: 2862 - DNA, 48 bp, Artificial Sequence
  Synthetic polynucleotide
gtattactccatccctaagtaaactatcccaagaggcagctacaggca

SEQ ID NO: 2863 - DNA, 48 bp, Artificial Sequence
  Synthetic polynucleotide
gagccgattcggtcacagattgtagctgtgaccctatcttacgcttac

SEQ ID NO: 2864 - DNA, 48 bp, Artificial Sequence
  Synthetic polynucleotide
agtgttttcgcagggtgctatgctttatgtgactggtctctcaatttc

SEQ ID NO: 2865 - DNA, 48 bp, Artificial Sequence
  Synthetic polynucleotide
aagatagggtcacagcagtaatacctctaccttacgaactcaacgcac

SEQ ID NO: 2866 - DNA, 48 bp, Artificial Sequence
  Synthetic polynucleotide
gcgctagtcacgcgaatttgtccatgcctgtacaatagtcgtgaccga

SEQ ID NO: 2867 - DNA, 48 bp, Artificial Sequence
  Synthetic polynucleotide
catcaagtaatatgcacgccccaactgctcctacctcttagcacaata

SEQ ID NO: 2868 - DNA, 48 bp, Artificial Sequence
  Synthetic polynucleotide
taagaggtaggagcagttggggcgctaatacgtggacaaattcgcgtg

SEQ ID NO: 2869 - DNA, 48 bp, Artificial Sequence
  Synthetic polynucleotide
tacaggtgtacgtcttacttgatgccaagcatgcttaacttataccat

SEQ ID NO: 2870 - DNA, 48 bp, Artificial Sequence
  Synthetic polynucleotide
cgattggtgattacacccagtcctaagtccgttattgctctgcagggt

SEQ ID NO: 2871 - DNA, 48 bp, Artificial Sequence
  Synthetic polynucleotide
tgttggacgtaagcgtgaaataacgaccagaagttctagggagcgggg

SEQ ID NO: 2872 - DNA, 48 bp, Artificial Sequence
  Synthetic polynucleotide
gaatgagcgacgcacctatgagttaccctgcaatcggctcaagacgta

SEQ ID NO: 2873 - DNA, 48 bp, Artificial Sequence
  Synthetic polynucleotide
agttaagcatgcttggaccaatcgtacacaaatccattcagttttacg

SEQ ID NO: 2874 - DNA, 48 bp, Artificial Sequence
  Synthetic polynucleotide
ggtacacggtgcgttgagttcgtaaggtagagactagcgccgccgatt

SEQ ID NO: 2875 - DNA, 48 bp, Artificial Sequence
  Synthetic polynucleotide
ctccgcatttccagtagtccaacatgataatcctcgtgcttcgagaaa

SEQ ID NO: 2876 - DNA, 48 bp, Artificial Sequence
  Synthetic polynucleotide
cctagaacttctggtcgttatttcactcgccgaactcataggtgcgtc

SEQ ID NO: 2877 - DNA, 48 bp, Artificial Sequence
  Synthetic polynucleotide
agcacgaggattatcacgtgtacctcgaaatagctcgggtagtctcaa

SEQ ID NO: 2878 - DNA, 48 bp, Artificial Sequence
  Synthetic polynucleotide
tgttaagcgtaaataagggccgacaatcggcgcacctgtatactggaa

SEQ ID NO: 2879 - DNA, 48 bp, Artificial Sequence
  Synthetic polynucleotide
taagaggcatggtatagcataatcttcgtggaagcagaatggtataaa

SEQ ID NO: 2880 - DNA, 48 bp, Artificial Sequence
  Synthetic polynucleotide
attctgcttccacgaagattatgctattgtgcgtcggcccttatttac

SEQ ID NO: 2881 - DNA, 48 bp, Artificial Sequence
  Synthetic polynucleotide
aagccactgcctacctgcctcttactgccttgcgactgggtccaaaag

SEQ ID NO: 2882 - DNA, 48 bp, Artificial Sequence
  Synthetic polynucleotide
agtgacaacgtaaaactgaatggatttgtgtagctcattcggagtgtt

SEQ ID NO: 2883 - DNA, 48 bp, Artificial Sequence
  Synthetic polynucleotide
atcgttagtttctcgactgttccgaaacaggcatggtacacccagcat

SEQ ID NO: 2884 - DNA, 48 bp, Artificial Sequence
  Synthetic polynucleotide
agcgtcgcttaaagtgtgataattaacactccatgcggagaggtaggc

SEQ ID NO: 2885 - DNA, 48 bp, Artificial Sequence
  Synthetic polynucleotide
cccagtcgcaaggcagttgtcactcatcggctcgttgaatgcctgtgc

SEQ ID NO: 2886 - DNA, 48 bp, Artificial Sequence
  Synthetic polynucleotide
taggttaattgagactacccgagctatttcgagcttaacacctttcac

SEQ ID NO: 2887 - DNA, 48 bp, Artificial Sequence
  Synthetic polynucleotide
actgtagtcacctaggctaacgatgtgggaggctaccgctaggagaaa

SEQ ID NO: 2888 - DNA, 48 bp, Artificial Sequence
  Synthetic polynucleotide
tgtaccatgcctgtttcggaacagccccgctcaattatcacactttaa

SEQ ID NO: 2889 - DNA, 48 bp, Artificial Sequence
  Synthetic polynucleotide
agcggtagcctcccacttaacctatgccttgggaagatagagagcata

SEQ ID NO: 2890 - DNA, 48 bp, Artificial Sequence
  Synthetic polynucleotide
aacgtgggaaactggtcggcagttgtgaaaggagtggcttcctaggtg

SEQ ID NO: 2891 - DNA, 48 bp, Artificial Sequence
  Synthetic polynucleotide
aacgatatcttttggagtccggtgtacgagatgcaataaagaaactgc

SEQ ID NO: 2892 - DNA, 48 bp, Artificial Sequence
  Synthetic polynucleotide
tttattgcatctcgtacaccggactttataccaactgccgaccagttt

SEQ ID NO: 2893 - DNA, 48 bp, Artificial Sequence
  Synthetic polynucleotide
tgctcgcgcccggtcaatatcgttacagagattcttcagggcagtttt

SEQ ID NO: 2894 - DNA, 48 bp, Artificial Sequence
  Synthetic polynucleotide
gcccttatgcacaggcattcaacgagccgatggcgacgctcatgttgt

SEQ ID NO: 2895 - DNA, 48 bp, Artificial Sequence
  Synthetic polynucleotide
taactgattttctcctggttccgctagctgattccttcagtccgccta

SEQ ID NO: 2896 - DNA, 48 bp, Artificial Sequence
  Synthetic polynucleotide
ggtgcaaaaagcgcaatgtccaagacaacatgactacagttgaccggg

SEQ ID NO: 2897 - DNA, 48 bp, Artificial Sequence
  Synthetic polynucleotide
cctgaagaatctctgtataagggcgattcttccctatgtcctgcttcg

SEQ ID NO: 2898 - DNA, 48 bp, Artificial Sequence
  Synthetic polynucleotide
cgagggtttatgctctctatcttcccaaggcacccacgtttatcagga

SEQ ID NO: 2899 - DNA, 48 bp, Artificial Sequence
  Synthetic polynucleotide
ttaaccatgacgccccatcagttaatattaaggaccatagtgtttcac

SEQ ID NO: 2900 - DNA, 48 bp, Artificial Sequence
  Synthetic polynucleotide
ctgaaggaatcagctagcggaaccatgctgggcttggacattgcgctt

SEQ ID NO: 2901 - DNA, 48 bp, Artificial Sequence
  Synthetic polynucleotide
ctatggtccttaatataaccctcggaggcaagaattcgctaaaccgga

SEQ ID NO: 2902 - DNA, 48 bp, Artificial Sequence
  Synthetic polynucleotide
gaaggctgtctttgtgttggtatatcctgatacgcgagcaggggcgtc

SEQ ID NO: 2903 - DNA, 48 bp, Artificial Sequence
  Synthetic polynucleotide
cgcgaatcaaaactgcgcctgatacaggtctcactcctactgcccgcc

SEQ ID NO: 2904 - DNA, 48 bp, Artificial Sequence
  Synthetic polynucleotide
gtaggagtgagacctgtatcaggcgcagtttctataccaacacaaaga

SEQ ID NO: 2905 - DNA, 48 bp, Artificial Sequence
  Synthetic polynucleotide
ggcgtttgcgaagcaggacatagggaagaatctttgcacctgatcaat

SEQ ID NO: 2906 - DNA, 48 bp, Artificial Sequence
  Synthetic polynucleotide
ccttgttacgatggcacggcgccgattgatcaatggttaagtataggt

SEQ ID NO: 2907 - DNA, 48 bp, Artificial Sequence
  Synthetic polynucleotide
tcggtgacacctatacgattcgcgattgatccacctcgcccatcagag

SEQ ID NO: 2908 - DNA, 48 bp, Artificial Sequence
  Synthetic polynucleotide
gggagagggtgaaacaggccacctggctcgggctcatgatctttgata

SEQ ID NO: 2909 - DNA, 48 bp, Artificial Sequence
  Synthetic polynucleotide
ggcgaggtggatcaatcaaacgccgagcgttgctgtccgtggtcagtc

SEQ ID NO: 2910 - DNA, 48 bp, Artificial Sequence
  Synthetic polynucleotide
gaggcggctccggtttagcgaattcttgcctccagccttcgggatttc

SEQ ID NO: 2911 - DNA, 48 bp, Artificial Sequence
  Synthetic polynucleotide
cccggtggagaaaacccctctccctgccgagggggcactcaaagcagg

SEQ ID NO: 2912 - DNA, 48 bp, Artificial Sequence
  Synthetic polynucleotide
atcatgagcccgagccaggtggcctaggcggacggcgccgtgccatcg

SEQ ID NO: 2913 - DNA, 48 bp, Artificial Sequence
  Synthetic polynucleotide
gagtgccccctcggcagccgcctcggttatacaaagtatccgcatctc

SEQ ID NO: 2914 - DNA, 48 bp, Artificial Sequence
  Synthetic polynucleotide
tagactttgactcagatgggtattgaaatcccgtcaccgaggttttct

SEQ ID NO: 2915 - DNA, 48 bp, Artificial Sequence
  Synthetic polynucleotide
tagccgacctctgatgtgatgtgagttgttggtcagagttcccaccac

SEQ ID NO: 2916 - DNA, 48 bp, Artificial Sequence
  Synthetic polynucleotide
aactctgaccaacaactcacatcaggcgggcaaatacccatctgagtc

SEQ ID NO: 2917 - DNA, 48 bp, Artificial Sequence
  Synthetic polynucleotide
cgccgaccggaacagagtcggctagcctcatagacacaacaccgtcca

SEQ ID NO: 2918 - DNA, 48 bp, Artificial Sequence
  Synthetic polynucleotide
cccatcttgactgaccacggacagcaacgctctaacaaggaaggtccg

SEQ ID NO: 2919 - DNA, 48 bp, Artificial Sequence
  Synthetic polynucleotide
tcgtcaagcctgctttccatagctaacccgatttctcccaaatggata

SEQ ID NO: 2920 - DNA, 48 bp, Artificial Sequence
  Synthetic polynucleotide
attgagcaggaatactgcaatattcggaccttccaccgggtctgttcc

SEQ ID NO: 2921 - DNA, 48 bp, Artificial Sequence
  Synthetic polynucleotide
gttgtgtctatgaggcaagatggggacaggaccttgaatatgcatcaa

SEQ ID NO: 2922 - DNA, 48 bp, Artificial Sequence
  Synthetic polynucleotide
agtacgacgagatgcggatactttgtataaccaaagtctagtctacag

SEQ ID NO: 2923 - DNA, 48 bp, Artificial Sequence
  Synthetic polynucleotide
gatagagaagaagggacttgacgatcacgtggaatgcacatcgggcac

SEQ ID NO: 2924 - DNA, 48 bp, Artificial Sequence
  Synthetic polynucleotide
tgggagaaatcgggttagctatggtatcaaagaatattgcagtattcc

SEQ ID NO: 2925 - DNA, 48 bp, Artificial Sequence
  Synthetic polynucleotide
tgtgcattccacgtgagtcgtacttaaagcaaactcagtgatcgagta

SEQ ID NO: 2926 - DNA, 48 bp, Artificial Sequence
  Synthetic polynucleotide
cccggatttcaggtcgcggatatgctgtagacggtcggcgtcccttct

SEQ ID NO: 2927 - DNA, 48 bp, Artificial Sequence
  Synthetic polynucleotide
tttggtaatggacggtcttcacatgttccctatgttgaacgttgctaa

SEQ ID NO: 2928 - DNA, 48 bp, Artificial Sequence
  Synthetic polynucleotide
gttcaacatagggaacatgtgaaggtggtgggcatatccgcgacctga

SEQ ID NO: 2929 - DNA, 48 bp, Artificial Sequence
  Synthetic polynucleotide
aaggaacgatgtgtacttaccaaactcccataaccgaactaggtacct

SEQ ID NO: 2930 - DNA, 48 bp, Artificial Sequence
  Synthetic polynucleotide
ttacaatcttgatgcatattcaaggtcctgtctgctcaatcccgcggt

SEQ ID NO: 2931 - DNA, 48 bp, Artificial Sequence
  Synthetic polynucleotide
acgtgggagtgcccgagcgtctgaggtatggtgggcgtaaacaaaaaa

SEQ ID NO: 2932 - DNA, 48 bp, Artificial Sequence
  Synthetic polynucleotide
ctctggctttaccaagcagccttcaccgcgggtctctatcgtacacat

SEQ ID NO: 2933 - DNA, 48 bp, Artificial Sequence
  Synthetic polynucleotide
agttcggttatgggaggattgtaagactactttcagatcccgcttctc

SEQ ID NO: 2934 - DNA, 48 bp, Artificial Sequence
  Synthetic polynucleotide
cacttgagtactcgatcactgagtttgctttaaatccgggacatatca

SEQ ID NO: 2935 - DNA, 48 bp, Artificial Sequence
  Synthetic polynucleotide
atgttccgttggcctttcccacgtacaacatagtgggtaagttatgga

SEQ ID NO: 2936 - DNA, 48 bp, Artificial Sequence
  Synthetic polynucleotide
ttacgcccaccatacctcagacgctatccattgaaggctgcttggtaa

SEQ ID NO: 2937 - DNA, 48 bp, Artificial Sequence
  Synthetic polynucleotide
ttacccactatgttgtctcaagtgctaacagtttcatgtcgccttttc

SEQ ID NO: 2938 - DNA, 48 bp, Artificial Sequence
  Synthetic polynucleotide
acgcgttttaatgccggcacgatatgatatgtcgttccttaaggccaa

SEQ ID NO: 2939 - DNA, 48 bp, Artificial Sequence
  Synthetic polynucleotide
tactcaaaaggtacctgcctggaccatttattggcacttgaacttcgc

SEQ ID NO: 2940 - DNA, 48 bp, Artificial Sequence
  Synthetic polynucleotide
caagtgccaataaatggtccaggcttagcaactatcgtgccggcatta

SEQ ID NO: 2941 - DNA, 48 bp, Artificial Sequence
  Synthetic polynucleotide
ttggcaaacatcgtgctttgagtaattcctcaatgaacccgcgtcgtc

SEQ ID NO: 2942 - DNA, 48 bp, Artificial Sequence
  Synthetic polynucleotide
ccgtcctcgagaagcgggatctgaaagtagtcagccagagactgtccc

SEQ ID NO: 2943 - DNA, 48 bp, Artificial Sequence
  Synthetic polynucleotide
actaattatccataactgtgcacgtcagggatcttgcctatcgtgccc

SEQ ID NO: 2944 - DNA, 48 bp, Artificial Sequence
  Synthetic polynucleotide
tccgggatgggtgccaccactaacgggacagtcggaacatgcacgatg

SEQ ID NO: 2945 - DNA, 48 bp, Artificial Sequence
  Synthetic polynucleotide
gggttcattgaggaatgaggacggtaaccaaaacccagaggttaacca

SEQ ID NO: 2946 - DNA, 48 bp, Artificial Sequence
  Synthetic polynucleotide
atgtagcagaaaaggcgacatgaaactgttagaaacgcgtctataacg

SEQ ID NO: 2947 - DNA, 48 bp, Artificial Sequence
  Synthetic polynucleotide
tccctaaagggtaaactaattagtacggccaccggtgagattccccag

SEQ ID NO: 2948 - DNA, 48 bp, Artificial Sequence
  Synthetic polynucleotide
taggcaagatccctgacgtgcacattttttgtgttagtggtggcaccc

SEQ ID NO: 2949 - DNA, 48 bp, Artificial Sequence
  Synthetic polynucleotide
tctcaccggtggccgttgctacatcagtttctgaacggtgacacactt

SEQ ID NO: 2950 - DNA, 48 bp, Artificial Sequence
  Synthetic polynucleotide
gctccccgcacgggttacatggaacgttatagtttgccaagtttaccc

SEQ ID NO: 2951 - DNA, 48 bp, Artificial Sequence
  Synthetic polynucleotide
agggcactgacgacgccagcatgcccggtttagacatattcaaatgag

SEQ ID NO: 2952 - DNA, 48 bp, Artificial Sequence
  Synthetic polynucleotide
aatatgtctaaaccgggcatgctggcgaagttttccatgtaacccgtg

SEQ ID NO: 2953 - DNA, 48 bp, Artificial Sequence
  Synthetic polynucleotide
ttcgtgtgtcttgtatagtgcccttatgcctataggaatgaactgcac

SEQ ID NO: 2954 - DNA, 48 bp, Artificial Sequence
  Synthetic polynucleotide
tagcgcactggttaacctctgggttttggttaatcccggacacgtaaa

SEQ ID NO: 2955 - DNA, 48 bp, Artificial Sequence
  Synthetic polynucleotide
ttgcactcctggggaaactatacttacgcacttcatacagcattgtct

SEQ ID NO: 2956 - DNA, 48 bp, Artificial Sequence
  Synthetic polynucleotide
ttcagcagccttactcccgcaacctttacgtgtttagggaatacaaga

SEQ ID NO: 2957 - DNA, 48 bp, Artificial Sequence
  Synthetic polynucleotide
cattcctataggcatagtgcgctaaaggtatttctaaggcagggtgta

SEQ ID NO: 2958 - DNA, 48 bp, Artificial Sequence
  Synthetic polynucleotide
gcaattgcaagtgtgtcaccgttcagaaactgcggggagcaaccgcgt

SEQ ID NO: 2959 - DNA, 48 bp, Artificial Sequence
  Synthetic polynucleotide
gttgttcccccccgaagagtgcaactaatccctccaaaccaaattgtg

SEQ ID NO: 2960 - DNA, 48 bp, Artificial Sequence
  Synthetic polynucleotide
ctgtatgaagtgcgtaagtatagtgggcacgaggttgcgggagtaagg

SEQ ID NO: 2961 - DNA, 48 bp, Artificial Sequence
  Synthetic polynucleotide
ggtttggagggattaggcaattgctaggttgcgtgttcattcagagta

SEQ ID NO: 2962 - DNA, 48 bp, Artificial Sequence
  Synthetic polynucleotide
cgaccgctctagatctttgtacccacgcggttcacacgaattcggggg

SEQ ID NO: 2963 - DNA, 48 bp, Artificial Sequence
  Synthetic polynucleotide
taatcgccgtgcagttcctgtagttgggtgttcagcgagcgttttacg

SEQ ID NO: 2964 - DNA, 48 bp, Artificial Sequence
  Synthetic polynucleotide
gctcgctgaacacccaactacaggctcatttggggtacaaagatctag

SEQ ID NO: 2965 - DNA, 48 bp, Artificial Sequence
  Synthetic polynucleotide
tcaccgcgtgacacccggcgattactgcgcagataacggacccgtgcg

SEQ ID NO: 2966 - DNA, 48 bp, Artificial Sequence
  Synthetic polynucleotide
atatttaatacaccctgccttagaaataccttctgctgaatgtccgtg

SEQ ID NO: 2967 - DNA, 48 bp, Artificial Sequence
  Synthetic polynucleotide
attgtaggcacaatttttgattcgatcacataaccacctatgttctta

SEQ ID NO: 2968 - DNA, 48 bp, Artificial Sequence
  Synthetic polynucleotide
gtccaagtaagggcaaagcaatatcacggacaggaacaacgggtgtca

SEQ ID NO: 2969 - DNA, 48 bp, Artificial Sequence
  Synthetic polynucleotide
tccgttatctgcgcagttaaatatagtcggagacttagcgtctatctg

SEQ ID NO: 2970 - DNA, 48 bp, Artificial Sequence
  Synthetic polynucleotide
caggctactactctgaatgaacacgcaacctaagcggtcgctaacagg

SEQ ID NO: 2971 - DNA, 48 bp, Artificial Sequence
  Synthetic polynucleotide
catacacaccgtcatgcctacaatagctttattgcccatggtgacacg

SEQ ID NO: 2972 - DNA, 48 bp, Artificial Sequence
  Synthetic polynucleotide
taggtggttatgtgatcgaatcaaagacaatgatattgctttgccctt

SEQ ID NO: 2973 - DNA, 48 bp, Artificial Sequence
  Synthetic polynucleotide
catgggcaataaagctgtagcctgaggcgcgcgcggaaatatggccgc

SEQ ID NO: 2974 - DNA, 48 bp, Artificial Sequence
  Synthetic polynucleotide
ccatcgctgataaagggtgtggcacctgttagcgcggtgacatgacgg

SEQ ID NO: 2975 - DNA, 48 bp, Artificial Sequence
  Synthetic polynucleotide
attaacgacgcacgggtcgaacctgctgtacggtgaacggtgggcatt

SEQ ID NO: 2976 - DNA, 48 bp, Artificial Sequence
  Synthetic polynucleotide
ccgttcaccgtacagcaggttcgacgtaaaactgccacaccctttatc

SEQ ID NO: 2977 - DNA, 48 bp, Artificial Sequence
  Synthetic polynucleotide
cgagttgaaaagtgagtcgttaatcttctctgaatagttggtactcat

SEQ ID NO: 2978 - DNA, 48 bp, Artificial Sequence
  Synthetic polynucleotide
actcactgcagatagacgctaagtctccgactacttggaccgggcatc

SEQ ID NO: 2979 - DNA, 48 bp, Artificial Sequence
  Synthetic polynucleotide
agctgcaccgtgtcaccttgatattgagggactgctgttaacatagat

SEQ ID NO: 2980 - DNA, 48 bp, Artificial Sequence
  Synthetic polynucleotide
tctggcgccggcttagtcgtatttgatgcccgtgtgtatgctcacttt

SEQ ID NO: 2981 - DNA, 48 bp, Artificial Sequence
  Synthetic polynucleotide
caactattcagagaagcagtgagtctagccaattcggctctcagcact

SEQ ID NO: 2982 - DNA, 48 bp, Artificial Sequence
  Synthetic polynucleotide
tatggtttgcggccatatttccgcgcgcgcctagcgatggtagtgttg

SEQ ID NO: 2983 - DNA, 48 bp, Artificial Sequence
  Synthetic polynucleotide
gcggcgaaagtgtgtagtgcagctatccgaatgacgaggtgccgatct

SEQ ID NO: 2984 - DNA, 48 bp, Artificial Sequence
  Synthetic polynucleotide
taacagcagtccctcaatatcaagtaagaacaaaatacgactaagccg

SEQ ID NO: 2985 - DNA, 48 bp, Artificial Sequence
  Synthetic polynucleotide
acctcgtcattcggataaaccatactgagggcttcggtgcgcagcggg

SEQ ID NO: 2986 - DNA, 48 bp, Artificial Sequence
  Synthetic polynucleotide
cgtcactagtcgcccggctcttaacaacactatcaactcgtacacact

SEQ ID NO: 2987 - DNA, 48 bp, Artificial Sequence
  Synthetic polynucleotide
gacgtaaaatgagtactcggtgtactttttgggactacctacatcagg

SEQ ID NO: 2988 - DNA, 48 bp, Artificial Sequence
  Synthetic polynucleotide
aggtagtcccaaaaagtacaccgaaatgcccattaagagccgggcgac

SEQ ID NO: 2989 - DNA, 48 bp, Artificial Sequence
  Synthetic polynucleotide
ttgcggtaaaaacgactttacgtctctatgccttgaaatggcagactt

SEQ ID NO: 2990 - DNA, 48 bp, Artificial Sequence
  Synthetic polynucleotide
gtccattcagtgctgagagccgaattggctaggcgccagaccacaatg

SEQ ID NO: 2991 - DNA, 48 bp, Artificial Sequence
  Synthetic polynucleotide
agtgggcgagatcggctaatcattagtgctcccgtcgggcgaccttcg

SEQ ID NO: 2992 - DNA, 48 bp, Artificial Sequence
  Synthetic polynucleotide
ctcagtttaagattcaccgtcacgcattgtggttcgccgcgtcgtttt

SEQ ID NO: 2993 - DNA, 48 bp, Artificial Sequence
  Synthetic polynucleotide
catttcaaggcatagagaatggactacacgtgcagtggtacttgagca

SEQ ID NO: 2994 - DNA, 48 bp, Artificial Sequence
  Synthetic polynucleotide
ctaatgaacccgctgcgcaccgaagccctcagtagtgacgttcgccct

SEQ ID NO: 2995 - DNA, 48 bp, Artificial Sequence
  Synthetic polynucleotide
gaagaggtcggggcatcgcccactctatgaactaactaagtggggcac

SEQ ID NO: 2996 - DNA, 48 bp, Artificial Sequence
  Synthetic polynucleotide
gcccgacgggagcactaatgattaatctatgtcgtgacggtgaatctt

SEQ ID NO: 2997 - DNA, 48 bp, Artificial Sequence
  Synthetic polynucleotide
cttagttagttcatagttcattaggggcggaaccgcctgtaacgctta

SEQ ID NO: 2998 - DNA, 48 bp, Artificial Sequence
  Synthetic polynucleotide
aacaacgtgtctcattaatcaagtagggcgaataccgcaaatgccccg

SEQ ID NO: 2999 - DNA, 48 bp, Artificial Sequence
  Synthetic polynucleotide
tgtttacaaagtctgcagaattctgacctcggtttgcgtgcctaacca

SEQ ID NO: 3000 - DNA, 48 bp, Artificial Sequence
  Synthetic polynucleotide
cacgcaaaccgaggtcagaattctcctgatgtacttgattaatgagac

SEQ ID NO: 3001 - DNA, 48 bp, Artificial Sequence
  Synthetic polynucleotide
acattccttgctcaagtaccactgcacgtgtaaaactgaggagaacat

SEQ ID NO: 3002 - DNA, 48 bp, Artificial Sequence
  Synthetic polynucleotide
attttggcggaacgggacaggacgatgttctcacctcttcaggtctta

SEQ ID NO: 3003 - DNA, 48 bp, Artificial Sequence
  Synthetic polynucleotide
cctatcactaagaccttgtaaacagctaaatcaggcgtcgtcgttggt

SEQ ID NO: 3004 - DNA, 48 bp, Artificial Sequence
  Synthetic polynucleotide
atgggctggtgccccacgtacagtaaccaacctaaggtggggccgacc

SEQ ID NO: 3005 - DNA, 48 bp, Artificial Sequence
  Synthetic polynucleotide
cgacgcctgatttagcaggaatgtattataaatttcaaaagaagaatt

SEQ ID NO: 3006 - DNA, 48 bp, Artificial Sequence
  Synthetic polynucleotide
ctcggccctaagcgttacaggcggttccgcccacgttgttacggctag

SEQ ID NO: 3007 - DNA, 48 bp, Artificial Sequence
  Synthetic polynucleotide
gcggatgcgctgagagcagcccattacccacaggtacacctcacttgc

SEQ ID NO: 3008 - DNA, 48 bp, Artificial Sequence
  Synthetic polynucleotide
ccaccttaggttggttactgtacgcgaaggtccgtcctgtcccgttcc

SEQ ID NO: 3009 - DNA, 48 bp, Artificial Sequence
  Synthetic polynucleotide
ggtgtacctgtgggtagggccgagcgctgggcatcagcccgggctttt

SEQ ID NO: 3010 - DNA, 48 bp, Artificial Sequence
  Synthetic polynucleotide
aactgtgtctgaggcccgacataactagccgtgtgataggctctcagc

SEQ ID NO: 3011 - DNA, 48 bp, Artificial Sequence
  Synthetic polynucleotide
atttgcaaaccaacgagcaaccgctctaagactgatcagccctgctaa

SEQ ID NO: 3012 - DNA, 48 bp, Artificial Sequence
  Synthetic polynucleotide
gctgatcagtcttagagcggttgctggttaggttatgtcgggcctcag

SEQ ID NO: 3013 - DNA, 48 bp, Artificial Sequence
  Synthetic polynucleotide
acgtccgaccatgcgattgcaaattctgggtgtaaaggtagatctcag

SEQ ID NO: 3014 - DNA, 48 bp, Artificial Sequence
  Synthetic polynucleotide
aggctagaaattcttcttttgaaatttataatgccaaaatcaaggacg

SEQ ID NO: 3015 - DNA, 48 bp, Artificial Sequence
  Synthetic polynucleotide
ttacatgtgcaagtgaaatatatgacttggtcaccgaccaaggcgcta

SEQ ID NO: 3016 - DNA, 48 bp, Artificial Sequence
  Synthetic polynucleotide
ttaagatgtgtggcaaaagcatcgcgtccttggcatccgctcgcatgg

SEQ ID NO: 3017 - DNA, 48 bp, Artificial Sequence
  Synthetic polynucleotide
tacctttacacccagatctagcctatgccgaaagctccatttagaatc

SEQ ID NO: 3018 - DNA, 48 bp, Artificial Sequence
  Synthetic polynucleotide
tggtggttaaaagcccgggctgatgcccagcgacacagttaggcgagg

SEQ ID NO: 3019 - DNA, 48 bp, Artificial Sequence
  Synthetic polynucleotide
acatgaggcgcgtgtaacatgtaatctagcagatctggtcattgaaag

SEQ ID NO: 3020 - DNA, 48 bp, Artificial Sequence
  Synthetic polynucleotide
tggtcggtgaccaagtcatatattggtcggcccgatgcttttgccaca

SEQ ID NO: 3021 - DNA, 48 bp, Artificial Sequence
  Synthetic polynucleotide
gaccagatctgctagaaaccaccaacatcctcgctaatacgctgagcg

SEQ ID NO: 3022 - DNA, 48 bp, Artificial Sequence
  Synthetic polynucleotide
aacttaaagatcgacgttggccctcctcgccttcggacgttacacgcg

SEQ ID NO: 3023 - DNA, 48 bp, Artificial Sequence
  Synthetic polynucleotide
ggccgtggctgagatccgcacctcctgtttaaaaaatatgcagggtta

SEQ ID NO: 3024 - DNA, 48 bp, Artificial Sequence
  Synthetic polynucleotide
catattttttaaacaggaggtgcgttagcaggagggccaacgtcgatc

SEQ ID NO: 3025 - DNA, 48 bp, Artificial Sequence
  Synthetic polynucleotide
tactcctgcgaccgttccacggccgctttgcgaagttggcccggtgag

SEQ ID NO: 3026 - DNA, 48 bp, Artificial Sequence
  Synthetic polynucleotide
acattacagattctaaatggagctttcggcatcatcttaaatataact

SEQ ID NO: 3027 - DNA, 48 bp, Artificial Sequence
  Synthetic polynucleotide
cttgacacctttcaatttttagtaaacacccatagggtatactcgtaa

SEQ ID NO: 3028 - DNA, 48 bp, Artificial Sequence
  Synthetic polynucleotide
tatccgcctatctcgctacaatatagttatatcctcatgtaacggtcg

SEQ ID NO: 3029 - DNA, 48 bp, Artificial Sequence
  Synthetic polynucleotide
gccaacttcgcaaagctgtaatgttcttatgagccatactgttgctcg

SEQ ID NO: 3030 - DNA, 48 bp, Artificial Sequence
  Synthetic polynucleotide
cgaccatgcgctcagcgtattagcgaggatgttttaagttacgaatac

SEQ ID NO: 3031 - DNA, 48 bp, Artificial Sequence
  Synthetic polynucleotide
gactctctggtcgggtgtgtcaagggaagttcagctctgttcctatga

SEQ ID NO: 3032 - DNA, 48 bp, Artificial Sequence
  Synthetic polynucleotide
ataccctatgggtgtttactaaaatagcgcctatattgtagcgagata

SEQ ID NO: 3033 - DNA, 48 bp, Artificial Sequence
  Synthetic polynucleotide
acagagctgaacttcccatggtcgttctactgatgctgttgttgcggg

SEQ ID NO: 3034 - DNA, 48 bp, Artificial Sequence
  Synthetic polynucleotide
ctccctgtcctgttggacgagattgtattcgtcaggagtaacccgacc

SEQ ID NO: 3035 - DNA, 48 bp, Artificial Sequence
  Synthetic polynucleotide
aacgaattctcaccggtggataaaaacttctatgaccctactacatct

SEQ ID NO: 3036 - DNA, 48 bp, Artificial Sequence
  Synthetic polynucleotide
tagggtcatagaagtttttatccataaccctgaatctcgtccaacagg

SEQ ID NO: 3037 - DNA, 48 bp, Artificial Sequence
  Synthetic polynucleotide
aaacttctagggctgcaattcgttttgcagattgcaattaagagtcta

SEQ ID NO: 3038 - DNA, 48 bp, Artificial Sequence
  Synthetic polynucleotide
agggggaccgagcaacagtatggctcataagaggcggatatggctggt

SEQ ID NO: 3039 - DNA, 48 bp, Artificial Sequence
  Synthetic polynucleotide
tcgtatgatcataggatcaaactaaatacagcgcgatatctgaatgcg

SEQ ID NO: 3040 - DNA, 48 bp, Artificial Sequence
  Synthetic polynucleotide
tcatcgtaggacatcaagagttctaccagccaagagagtcgcagccct

SEQ ID NO: 3041 - DNA, 48 bp, Artificial Sequence
  Synthetic polynucleotide
taattgcaatctgcaagtccccctacttactgcagcttcgaaattgca

SEQ ID NO: 3042 - DNA, 48 bp, Artificial Sequence
  Synthetic polynucleotide
aataaggacccgcaacaacagcatcagtagaaacagggagaacaaaat

SEQ ID NO: 3043 - DNA, 48 bp, Artificial Sequence
  Synthetic polynucleotide
cccgcgtattgcagtttcatacgacaagaactggcggtaccaaacatt

SEQ ID NO: 3044 - DNA, 48 bp, Artificial Sequence
  Synthetic polynucleotide
gatatcgcgctgtatttagtttgattacgagtagaactcttgatgtcc

SEQ ID NO: 3045 - DNA, 48 bp, Artificial Sequence
  Synthetic polynucleotide
gtaccgccagttcttgtccttattggcgatcggtttctgaaccggaac

SEQ ID NO: 3046 - DNA, 48 bp, Artificial Sequence
  Synthetic polynucleotide
cagagcactacacgccattttcggattttgttagaagtttaactgcaa

SEQ ID NO: 3047 - DNA, 48 bp, Artificial Sequence
  Synthetic polynucleotide
aaggagcttagactcttcctaacaagacgctgccttcgcgcccgacaa

SEQ ID NO: 3048 - DNA, 48 bp, Artificial Sequence
  Synthetic polynucleotide
cgcgaaggcagcgtcttgttaggaagatgtagccgaaaatggcgtgta

SEQ ID NO: 3049 - DNA, 48 bp, Artificial Sequence
  Synthetic polynucleotide
acagccttctccattgagctccttttcacacaagtgcgactttcactg

SEQ ID NO: 3050 - DNA, 48 bp, Artificial Sequence
  Synthetic polynucleotide
gctacgcatgcaatttcgaagctgcagtaagttacgatgacgtcgagg

SEQ ID NO: 3051 - DNA, 48 bp, Artificial Sequence
  Synthetic polynucleotide
tgcattccaatgtttgatggccgcgtggcttataatacgaaacgacaa

SEQ ID NO: 3052 - DNA, 48 bp, Artificial Sequence
  Synthetic polynucleotide
gtgggcgcaaaccgttcatctctgcctcgacgtacgcgggcaatggag

SEQ ID NO: 3053 - DNA, 48 bp, Artificial Sequence
  Synthetic polynucleotide
gtcgcacttgtgtgaatgcgtagcatgcaccgcgataccaaatgagaa

SEQ ID NO: 3054 - DNA, 48 bp, Artificial Sequence
  Synthetic polynucleotide
atgtggttgttccggttcagaaaccgatcgccgtgctctgtgtttgat

SEQ ID NO: 3055 - DNA, 48 bp, Artificial Sequence
  Synthetic polynucleotide
aagttgaatactctaaggaatgcaacaccggccgtcttaatgactacc

SEQ ID NO: 3056 - DNA, 48 bp, Artificial Sequence
  Synthetic polynucleotide
tcgtattataagccacgcggccatcgcattcacagagatgaacggttt

SEQ ID NO: 3057 - DNA, 48 bp, Artificial Sequence
  Synthetic polynucleotide
ttaagacggccggtgtaaccacataaagtcgtccgggctaatgaagcc

SEQ ID NO: 3058 - DNA, 48 bp, Artificial Sequence
  Synthetic polynucleotide
aagcggattcgagcgtgtcttgacatcaaacaaaggctgtttagagta

SEQ ID NO: 3059 - DNA, 48 bp, Artificial Sequence
  Synthetic polynucleotide
cttgacaacagtgaaataggacggctataaaactttgaaacctgtgct

SEQ ID NO: 3060 - DNA, 48 bp, Artificial Sequence
  Synthetic polynucleotide
tttcaaagttttatagccgtcctattgtcggggtcaagacacgctcga

SEQ ID NO: 3061 - DNA, 48 bp, Artificial Sequence
  Synthetic polynucleotide
cttaaccgctgtttaattgtcaagactagctcggttgagtaactccgg

SEQ ID NO: 3062 - DNA, 48 bp, Artificial Sequence
  Synthetic polynucleotide
atattagcttctcatttggtatcgcggtgcatgcgcccactcgggaca

SEQ ID NO: 3063 - DNA, 48 bp, Artificial Sequence
  Synthetic polynucleotide
ccgcctccggtagtcaacgcggaacgtaatggaaaataccttcgccgg

SEQ ID NO: 3064 - DNA, 48 bp, Artificial Sequence
  Synthetic polynucleotide
ttgaaggtttgaaccaaccacacttgtcccgattcaacttttaaacag

SEQ ID NO: 3065 - DNA, 48 bp, Artificial Sequence
  Synthetic polynucleotide
actcaaccgagctagtgctaatatcctctaagaagccaatcatgccat

SEQ ID NO: 3066 - DNA, 48 bp, Artificial Sequence
  Synthetic polynucleotide
tttttgtcggcttcattagcccggacgactttatccgcttctgcccat

SEQ ID NO: 3067 - DNA, 48 bp, Artificial Sequence
  Synthetic polynucleotide
tcaaggaacagttgccggaggcgggggtatagactttctggctgttca

SEQ ID NO: 3068 - DNA, 48 bp, Artificial Sequence
  Synthetic polynucleotide
ggtattttccattacgttccgcgtttgtcgttagtgtggttggttcaa

SEQ ID NO: 3069 - DNA, 48 bp, Artificial Sequence
  Synthetic polynucleotide
cagaaagtctatacccgacaaaaacagatttggtgaccccagagactg

SEQ ID NO: 3070 - DNA, 48 bp, Artificial Sequence
  Synthetic polynucleotide
ttgtaacttaatccatcgcaggggatgggcagcggttaagggcaactg

SEQ ID NO: 3071 - DNA, 48 bp, Artificial Sequence
  Synthetic polynucleotide
gttctgtcccggagttttaaacgtgcccgctagctgcctgttgtcccc

SEQ ID NO: 3072 - DNA, 48 bp, Artificial Sequence
  Synthetic polynucleotide
caggcagctagcgggcacgtttaaagcacaggcccctgcgatggatta

SEQ ID NO: 3073 - DNA, 48 bp, Artificial Sequence
  Synthetic polynucleotide
tccttactcctgggaagacagaacaaccccctaacgaacggcccccca

SEQ ID NO: 3074 - DNA, 48 bp, Artificial Sequence
  Synthetic polynucleotide
agcgcgccatggcatgattggcttcttagaggaccttcaatcgtctac

SEQ ID NO: 3075 - DNA, 48 bp, Artificial Sequence
  Synthetic polynucleotide
taccggggtgaacagcacgtgcggcttctccttccgtccgttggagcc

SEQ ID NO: 3076 - DNA, 48 bp, Artificial Sequence
  Synthetic polynucleotide
ttattgagacctatctgtagagtcgtagacgattccttgattcccagg

SEQ ID NO: 3077 - DNA, 48 bp, Artificial Sequence
  Synthetic polynucleotide
cgttcgttagggggttggcgcgctatcactaccggcgcatggtcgacg

SEQ ID NO: 3078 - DNA, 48 bp, Artificial Sequence
  Synthetic polynucleotide
agagtatacagtctctggggtcaccaaatctgagttacaacaagcggg

SEQ ID NO: 3079 - DNA, 48 bp, Artificial Sequence
  Synthetic polynucleotide
ttgtgaacgtgtaatgccccggtaatacacaaggcgatacagtggagc

SEQ ID NO: 3080 - DNA, 48 bp, Artificial Sequence
  Synthetic polynucleotide
cggacggaaggagaagccgcacgtccggcgaagactctacagataggt

SEQ ID NO: 3081 - DNA, 48 bp, Artificial Sequence
  Synthetic polynucleotide
gtatcgccttgtgtattatactcttgcgggggtctgatgcaccgggag

SEQ ID NO: 3082 - DNA, 48 bp, Artificial Sequence
  Synthetic polynucleotide
tcagtgattccagagccttaatgacccgcttgagtaaggacattacac

SEQ ID NO: 3083 - DNA, 48 bp, Artificial Sequence
  Synthetic polynucleotide
ctgggttgtggggggctgcatggtcatctttttcgtcatagggtccca

SEQ ID NO: 3084 - DNA, 48 bp, Artificial Sequence
  Synthetic polynucleotide
tatgacgaaaaagatgaccatgcaggggacaatcattaaggctctgga

SEQ ID NO: 3085 - DNA, 48 bp, Artificial Sequence
  Synthetic polynucleotide
aacaaggatagccagccaacccagattagattagatgatctcggcgac

SEQ ID NO: 3086 - DNA, 48 bp, Artificial Sequence
  Synthetic polynucleotide
tacaggatcgtcgaccatgcgccggtagtgatctcaataagagtacat

SEQ ID NO: 3087 - DNA, 48 bp, Artificial Sequence
  Synthetic polynucleotide
ggtcgagcgctccactgtagtggccggccatccacgaaccaacgcatc

SEQ ID NO: 3088 - DNA, 48 bp, Artificial Sequence
  Synthetic polynucleotide
tagtacagtgggagtgtcgtgcgaatgtactcgttcacaagctggcta

SEQ ID NO: 3089 - DNA, 48 bp, Artificial Sequence
  Synthetic polynucleotide
gatcatctaatctaatatcctgtacgcttcgaacaatgacgaaatcgc

SEQ ID NO: 3090 - DNA, 48 bp, Artificial Sequence
  Synthetic polynucleotide
gattgccgctcccggtgcatcagacccccgcaatcactgaactccgct

SEQ ID NO: 3091 - DNA, 48 bp, Artificial Sequence
  Synthetic polynucleotide
catcacggtaggtcgggctcgaccgcgctttctagtccacgcgtatcg

SEQ ID NO: 3092 - DNA, 48 bp, Artificial Sequence
  Synthetic polynucleotide
ggttcgtggatggccggccactacggctccaatcgcacgacactccca

SEQ ID NO: 3093 - DNA, 48 bp, Artificial Sequence
  Synthetic polynucleotide
gtggactagaaagcgccggcaatctgaatatcccagccacttagctgt

SEQ ID NO: 3094 - DNA, 48 bp, Artificial Sequence
  Synthetic polynucleotide
aaggagagggcgactggttaacacagcggagttccttgttccgaccta

SEQ ID NO: 3095 - DNA, 48 bp, Artificial Sequence
  Synthetic polynucleotide
atctctgggtcgccgataatcataaacctagaagaacggccgtctcac

SEQ ID NO: 3096 - DNA, 48 bp, Artificial Sequence
  Synthetic polynucleotide
gccgttcttctaggtttatgattatgggacccgtgttaaccagtcgcc

SEQ ID NO: 3097 - DNA, 48 bp, Artificial Sequence
  Synthetic polynucleotide
gcctacgtcgaagtctccagagatatggcctagcccatcaccaacagg

SEQ ID NO: 3098 - DNA, 48 bp, Artificial Sequence
  Synthetic polynucleotide
aaatcagtgcgatttcgtcattgttcgaagcgctgtactatgctgtag

SEQ ID NO: 3099 - DNA, 48 bp, Artificial Sequence
  Synthetic polynucleotide
gctacctccgatacgcgaaccagaaccatttacttagtgctgtagttt

SEQ ID NO: 3100 - DNA, 48 bp, Artificial Sequence
  Synthetic polynucleotide
tgcgttcgacgcctgcatcacgctctacagcaccgtgatgagacttcg

SEQ ID NO: 3101 - DNA, 48 bp, Artificial Sequence
  Synthetic polynucleotide
tgatgggctaggccatactgattttcgtccgggggttactatattgta

SEQ ID NO: 3102 - DNA, 48 bp, Artificial Sequence
  Synthetic polynucleotide
ttggctgaacagctaagtggctgggatattcactctccttcggcaata

SEQ ID NO: 3103 - DNA, 48 bp, Artificial Sequence
  Synthetic polynucleotide
cgatgcggagttgagtgaggtagcgcactgcccctactctcacctttc

SEQ ID NO: 3104 - DNA, 48 bp, Artificial Sequence
  Synthetic polynucleotide
gcactaagtaaatggttctggttcgatgcgttagcgtgatgcaggcgt

SEQ ID NO: 3105 - DNA, 48 bp, Artificial Sequence
  Synthetic polynucleotide
agagtaggggcagtgctcagccaaacagtggggtcagtgtgatcgcga

SEQ ID NO: 3106 - DNA, 48 bp, Artificial Sequence
  Synthetic polynucleotide
cggtgaaaccaagatttagacaggtattgccgacgtaggcactcaact

SEQ ID NO: 3107 - DNA, 48 bp, Artificial Sequence
  Synthetic polynucleotide
gcttcgcgcctgttggccgatcattcacgacatccaatacgggatctc

SEQ ID NO: 3108 - DNA, 48 bp, Artificial Sequence
  Synthetic polynucleotide
gtattggatgtcgtgaatgatcgggtgagacgcctgtctaaatcttgg

SEQ ID NO: 3109 - DNA, 48 bp, Artificial Sequence
  Synthetic polynucleotide
ttggaatgcccctcagcgcgaagccatctagcgggagattgcgactca

SEQ ID NO: 3110 - DNA, 48 bp, Artificial Sequence
  Synthetic polynucleotide
gaagtttttacaatatagtaacccccggacgacgaacgcattgcgggg

SEQ ID NO: 3111 - DNA, 48 bp, Artificial Sequence
  Synthetic polynucleotide
acatctcggaaaggtgtcccaagtgcaagtaaaccattaccggaggcg

SEQ ID NO: 3112 - DNA, 48 bp, Artificial Sequence
  Synthetic polynucleotide
gaggggatagcataccttccgtggccccgcaaccgcatcgctgagggg

SEQ ID NO: 3113 - DNA, 48 bp, Artificial Sequence
  Synthetic polynucleotide
aatctcccgctagatgaaaacttcacatatgatcagtgaagcgacgaa

SEQ ID NO: 3114 - DNA, 48 bp, Artificial Sequence
  Synthetic polynucleotide
ccacatgatcgcgatcacactgaccccactgttttcaccgtgtattct

SEQ ID NO: 3115 - DNA, 48 bp, Artificial Sequence
  Synthetic polynucleotide
gatcaccctctcgatacgagatgttctcataattccttttaggtctac

SEQ ID NO: 3116 - DNA, 48 bp, Artificial Sequence
  Synthetic polynucleotide
gtaatggtttacttgcacttgggaaaactacaccacggaaggtatgct

SEQ ID NO: 3117 - DNA, 48 bp, Artificial Sequence
  Synthetic polynucleotide
aaaaggaattatgagatcatgtgggatcctaagttccctctagctagg

SEQ ID NO: 3118 - DNA, 48 bp, Artificial Sequence
  Synthetic polynucleotide
tccacacaagcaaagagttatagaagaatacacattccaatatcgaga

SEQ ID NO: 3119 - DNA, 48 bp, Artificial Sequence
  Synthetic polynucleotide
ctcagcaatgagtcgcttgagtcggtggataaccatttaatggcaaat

SEQ ID NO: 3120 - DNA, 48 bp, Artificial Sequence
  Synthetic polynucleotide
ttaaatggttatccaccgactcaagagatccctctataactctttgct

SEQ ID NO: 3121 - DNA, 48 bp, Artificial Sequence
  Synthetic polynucleotide
cctagtcataacggccttgctgagttcgacgcaaactaaattgatccg

SEQ ID NO: 3122 - DNA, 48 bp, Artificial Sequence
  Synthetic polynucleotide
gaggtgatttcgtcgcttcactgatcatatgtatcccctcgcgagggt

SEQ ID NO: 3123 - DNA, 48 bp, Artificial Sequence
  Synthetic polynucleotide
agtttctggtagacctcgtaggctagagcggtcattaggtctattata

SEQ ID NO: 3124 - DNA, 48 bp, Artificial Sequence
  Synthetic polynucleotide
gtcgtaatgtgctgtgcagcacaaaccctcgcgggtgatcggccgtta

SEQ ID NO: 3125 - DNA, 48 bp, Artificial Sequence
  Synthetic polynucleotide
tttagtttgcgtcgaaatcacctcaaacgtcaacggcccgtgccgtaa

SEQ ID NO: 3126 - DNA, 48 bp, Artificial Sequence
  Synthetic polynucleotide
gtaaacgacctagctagagggaacttaggatctgtgtggactaactat

SEQ ID NO: 3127 - DNA, 48 bp, Artificial Sequence
  Synthetic polynucleotide
ttgttgcgaaactaaacagaaactatgtaccgtggatatcatgccagc

SEQ ID NO: 3128 - DNA, 48 bp, Artificial Sequence
  Synthetic polynucleotide
acctaatgaccgctctagcctacgcgcctccgttgtgctgcacagcac

SEQ ID NO: 3129 - DNA, 48 bp, Artificial Sequence
  Synthetic polynucleotide
gatatccacggtacattcgtttactgcacggagtgatgccaaaagggt

SEQ ID NO: 3130 - DNA, 48 bp, Artificial Sequence
  Synthetic polynucleotide
cgcgttagatgttaactccttggcatagttagtgactaggtttagttt

SEQ ID NO: 3131 - DNA, 48 bp, Artificial Sequence
  Synthetic polynucleotide
tagccctacggatcaagtcaatttctttacgttgtatctcacgggccc

SEQ ID NO: 3132 - DNA, 48 bp, Artificial Sequence
  Synthetic polynucleotide
gagatacaacgtaaagaaattgacatttgccagccaaggagttaacat

SEQ ID NO: 3133 - DNA, 48 bp, Artificial Sequence
  Synthetic polynucleotide
tatcggtttttgcatttagggctaatttctacaatcgtgacggtttct

SEQ ID NO: 3134 - DNA, 48 bp, Artificial Sequence
  Synthetic polynucleotide
tttgtaaattacggcacgggccgttgacgtttattacgacaaggagat

SEQ ID NO: 3135 - DNA, 48 bp, Artificial Sequence
  Synthetic polynucleotide
acgagagtgctggcataagcaagagaaacctaatgggacgccactacg

SEQ ID NO: 3136 - DNA, 48 bp, Artificial Sequence
  Synthetic polynucleotide
accatgttgaaattgtttctatcgatctccttcgcaacaaaatgcaaa

SEQ ID NO: 3137 - DNA, 48 bp, Artificial Sequence
  Synthetic polynucleotide
tcacgattgtagaaattttacaaagacggacagtgaattttgcgccca

SEQ ID NO: 3138 - DNA, 48 bp, Artificial Sequence
  Synthetic polynucleotide
tcgcaacgacccttttggcatcactccgtgcactaacgcggtaccgca

SEQ ID NO: 3139 - DNA, 48 bp, Artificial Sequence
  Synthetic polynucleotide
cgccgtgtcaccaggtactctcgtatcttagtccccaagtgctacatg

SEQ ID NO: 3140 - DNA, 48 bp, Artificial Sequence
  Synthetic polynucleotide
cgtcccattaggtttctcttgctttataatagcgatagaaacaatttc

SEQ ID NO: 3141 - DNA, 48 bp, Artificial Sequence
  Synthetic polynucleotide
acttggggactaagatcgttgcgaattttcgcggatatggagctggaa

SEQ ID NO: 3142 - DNA, 48 bp, Artificial Sequence
  Synthetic polynucleotide
taaagcgagtaacgacttatgcattgcggtacaaccgataacctggtg

SEQ ID NO: 3143 - DNA, 48 bp, Artificial Sequence
  Synthetic polynucleotide
tcttcaaaagaaaccgcggaatgacggagcctagttgaccactatcaa

SEQ ID NO: 3144 - DNA, 48 bp, Artificial Sequence
  Synthetic polynucleotide
ggtcaactaggctccgtcattccggggcccgtatgcataagtcgttac

SEQ ID NO: 3145 - DNA, 48 bp, Artificial Sequence
  Synthetic polynucleotide
agtgcgccatcgctgatttgaagatgtcaggggtggcggacgtctatt

SEQ ID NO: 3146 - DNA, 48 bp, Artificial Sequence
  Synthetic polynucleotide
ggcggctatgggcgcaaaattcactgtccgtcaacatggtgcctcgtg

SEQ ID NO: 3147 - DNA, 48 bp, Artificial Sequence
  Synthetic polynucleotide
gcgattcgcatgtagccgaacgagatcgtccttatcgttctataaaat

SEQ ID NO: 3148 - DNA, 48 bp, Artificial Sequence
  Synthetic polynucleotide
cgcatctacctagcaagctgccgacacgaggcacacggcgtcagcgat

SEQ ID NO: 3149 - DNA, 48 bp, Artificial Sequence
  Synthetic polynucleotide
tccgccacccctgacatagccgccttgggggataggcccccattgacg

SEQ ID NO: 3150 - DNA, 48 bp, Artificial Sequence
  Synthetic polynucleotide
cggcatgcttccagctccatatccgcgaaaattcgctttatttcatag

SEQ ID NO: 3151 - DNA, 48 bp, Artificial Sequence
  Synthetic polynucleotide
caacacaacagaattacgaatcgcaggagatccgtcgtctagcacgca

SEQ ID NO: 3152 - DNA, 48 bp, Artificial Sequence
  Synthetic polynucleotide
gaacgataaggacgatctcgttcgcgtagtggtcggcagcttgctagg

SEQ ID NO: 3153 - DNA, 48 bp, Artificial Sequence
  Synthetic polynucleotide
agacgacggatctcctgcatgccggtagcacccggctctgatttctag

SEQ ID NO: 3154 - DNA, 48 bp, Artificial Sequence
  Synthetic polynucleotide
ggttaagtttgacatcgaccaactctatgaaaggcgcacttaattctg

SEQ ID NO: 3155 - DNA, 48 bp, Artificial Sequence
  Synthetic polynucleotide
gcacgttaaatagacggcgcggaagacctccgtaagggtattgtccta

SEQ ID NO: 3156 - DNA, 48 bp, Artificial Sequence
  Synthetic polynucleotide
tacccttacggaggtcttccgcgcttgatagtagttggtcgatgtcaa

SEQ ID NO: 3157 - DNA, 48 bp, Artificial Sequence
  Synthetic polynucleotide
ttgcgctgactacacctaacgtgcctgatcacccgctgaaggcagtgg

SEQ ID NO: 3158 - DNA, 48 bp, Artificial Sequence
  Synthetic polynucleotide
tcaataatcgtcaatgggggcctatcccccaatagatgcgtgttctac

SEQ ID NO: 3159 - DNA, 48 bp, Artificial Sequence
  Synthetic polynucleotide
gtcaaatatgcgtgcttttaacgctttagaccggcactgtcacggcgc

SEQ ID NO: 3160 - DNA, 48 bp, Artificial Sequence
  Synthetic polynucleotide
ggattcatttaactactaagacaagtagaacattgtgttgggtgtagt

SEQ ID NO: 3161 - DNA, 48 bp, Artificial Sequence
  Synthetic polynucleotide
ttcagcgggtgatcagattattgaataatcctccgagccagtctcgcc

SEQ ID NO: 3162 - DNA, 48 bp, Artificial Sequence
  Synthetic polynucleotide
tgattagcctagaaatcagagccgggtgctacacttaaccgcaggtgg

SEQ ID NO: 3163 - DNA, 48 bp, Artificial Sequence
  Synthetic polynucleotide
tcatggtagaggcctttatttgacgtcttgcgtcaagctgtctgcaac

SEQ ID NO: 3164 - DNA, 48 bp, Artificial Sequence
  Synthetic polynucleotide
acagtgccggtctaaagcgttaaaattttatattgtcttagtagttaa

SEQ ID NO: 3165 - DNA, 48 bp, Artificial Sequence
  Synthetic polynucleotide
cagcttgacgcaagacgctaatcactgggcagtgacctggtataatgg

SEQ ID NO: 3166 - DNA, 48 bp, Artificial Sequence
  Synthetic polynucleotide
taggcagggtactgcttaaattaaccacctgccagcgcaaaaggcctc

SEQ ID NO: 3167 - DNA, 48 bp, Artificial Sequence
  Synthetic polynucleotide
aggaaataccactgccttcctaacgcaggtgccggcggctcaacccgt

SEQ ID NO: 3168 - DNA, 48 bp, Artificial Sequence
  Synthetic polynucleotide
agccgccggcacctgcgttaggaataggacaattaatttaagcagtac

SEQ ID NO: 3169 - DNA, 48 bp, Artificial Sequence
  Synthetic polynucleotide
agtccttccctgctcctatttccttacctgctcctgaatgtccatgta

SEQ ID NO: 3170 - DNA, 48 bp, Artificial Sequence
  Synthetic polynucleotide
cttttctgggcgagactggctcggaggattatatgaatccttaggtaa

SEQ ID NO: 3171 - DNA, 48 bp, Artificial Sequence
  Synthetic polynucleotide
ggtcctaggttgcagaaacctaccccctaagcctttcagtgtgagtgt

SEQ ID NO: 3172 - DNA, 48 bp, Artificial Sequence
  Synthetic polynucleotide
gattgactaatacattcgatgttattacctaataccatgaggagcagg

SEQ ID NO: 3173 - DNA, 48 bp, Artificial Sequence
  Synthetic polynucleotide
cattcaggagcaggtacagaaaaggaaccgaccccgcaagtagtctcg

SEQ ID NO: 3174 - DNA, 48 bp, Artificial Sequence
  Synthetic polynucleotide
ggaacttgccattataccaggtcactgcccagcctgcctatcccgtct

SEQ ID NO: 3175 - DNA, 48 bp, Artificial Sequence
  Synthetic polynucleotide
gtgtacctttggtgcactaggacctaacccttactacgctggactcat

SEQ ID NO: 3176 - DNA, 48 bp, Artificial Sequence
  Synthetic polynucleotide
actgaaaggcttagggggtaggttgcgccgtgtaacatcgaatgtatt

SEQ ID NO: 3177 - DNA, 48 bp, Artificial Sequence
  Synthetic polynucleotide
agcgtagtaagggttacaagttcctgcggcggcggagctacctgacct

SEQ ID NO: 3178 - DNA, 48 bp, Artificial Sequence
  Synthetic polynucleotide
ctaaagacggggttgatccatactagacgggagaaggacttgcaccaa

SEQ ID NO: 3179 - DNA, 48 bp, Artificial Sequence
  Synthetic polynucleotide
gagtgcgttacatggaataagtctctcggcgtgcaggttaagcatgtc

SEQ ID NO: 3180 - DNA, 48 bp, Artificial Sequence
  Synthetic polynucleotide
taacctgcacgccgagagacttatacgggttgagtatggatcaacccc

SEQ ID NO: 3181 - DNA, 48 bp, Artificial Sequence
  Synthetic polynucleotide
ggaaggtctccccggaacgcactctctccacacatggagtagcgccca

SEQ ID NO: 3182 - DNA, 48 bp, Artificial Sequence
  Synthetic polynucleotide
gttgctaccgagactacttgcggggtcggttcagtcaatccgtgtctg

SEQ ID NO: 3183 - DNA, 48 bp, Artificial Sequence
  Synthetic polynucleotide
ctgtacgaatgagtccggccttgacatgacatgatgacctcgcagcct

SEQ ID NO: 3184 - DNA, 48 bp, Artificial Sequence
  Synthetic polynucleotide
gtagtctgtagggtgatatgaatccagacacgaggtacactccgggga

SEQ ID NO: 3185 - DNA, 48 bp, Artificial Sequence
  Synthetic polynucleotide
actccatgtgtggagagtagcaacggctgtcagaacctttacttacca

SEQ ID NO: 3186 - DNA, 48 bp, Artificial Sequence
  Synthetic polynucleotide
tgctggtgaggtcaggtagctccgccgccgcagtctttagtctttgca

SEQ ID NO: 3187 - DNA, 48 bp, Artificial Sequence
  Synthetic polynucleotide
cacttgacaaatgtgatcgtacagttggacgggtgggagatgtcaagt

SEQ ID NO: 3188 - DNA, 48 bp, Artificial Sequence
  Synthetic polynucleotide
aggtcatcatgtcatgtcaaggccacactcacgattcatatcacccta

SEQ ID NO: 3189 - DNA, 48 bp, Artificial Sequence
  Synthetic polynucleotide
tctcccacccgtccaacaccagcaggatgtcgcaatcatacgtcccac

SEQ ID NO: 3190 - DNA, 48 bp, Artificial Sequence
  Synthetic polynucleotide
ttattgggggtgaagagagggctgtgcaaagagaccttcctcacattt

SEQ ID NO: 3191 - DNA, 48 bp, Artificial Sequence
  Synthetic polynucleotide
aggtcaactgggcgctaaatgtggccctttgcttgcaacttaagattc

SEQ ID NO: 3192 - DNA, 48 bp, Artificial Sequence
  Synthetic polynucleotide
agttgcaagcaaagggccacatttgacatgctcagccctctcttcacc

SEQ ID NO: 3193 - DNA, 48 bp, Artificial Sequence
  Synthetic polynucleotide
taaccaggtggtaagtaaaggttctgacagcccagactacgagcttgc

SEQ ID NO: 3194 - DNA, 48 bp, Artificial Sequence
  Synthetic polynucleotide
cgcagcactacgctcctatacccggcaagctcgtcaagtggtatagcc

SEQ ID NO: 3195 - DNA, 48 bp, Artificial Sequence
  Synthetic polynucleotide
gtcaggagttagggtcagcaaacagttccttcatactgtctttttttt

SEQ ID NO: 3196 - DNA, 32 bp, Artificial Sequence; identical to SEQ ID NO: 39
  Synthetic polynucleotide

SEQ ID NO: 3197 - DNA, 32 bp, Artificial Sequence; identical to SEQ ID NO: 1254
  Synthetic polynucleotide

SEQ ID NO: 3198 - DNA, 32 bp, Artificial Sequence
  Synthetic polynucleotide
gacagtatgaaggaaccgggagcctcggggga

SEQ ID NO: 3199 - DNA, 32 bp, Artificial Sequence
  Synthetic polynucleotide
tttttttttgtaaagggatagctgtttttttt

SEQ ID NO: 3200 - DNA, 32 bp, Artificial Sequence
  Synthetic polynucleotide
ttttttttatcatctcgtagatcctttttttt

SEQ ID NO: 3201 - DNA, 32 bp, Artificial Sequence
  Synthetic polynucleotide
tttttttttcccccgaggggactctttttttt

SEQ ID NO: 3202 - DNA, 48 bp, Artificial Sequence
  Synthetic polynucleotide
ttttttttgagccacttaacctgggtttccttacattggtgcatgccg

SEQ ID NO: 3203 - DNA, 48 bp, Artificial Sequence
  Synthetic polynucleotide
ttttttttgatgtccgcttacatcttgacctagtgccgtatattcttc

SEQ ID NO: 3204 - DNA, 48 bp, Artificial Sequence
  Synthetic polynucleotide
tgagattaacgccctggggactgcattccatgtaggaaaatttttttt

SEQ ID NO: 3205 - DNA, 32 bp, Artificial Sequence; identical to SEQ ID NO: 1923
  Synthetic polynucleotide

SEQ ID NO: 3206 - DNA, 32 bp, Artificial Sequence
  Synthetic polynucleotide
aaactactttaggtgataatctcatttttaac

SEQ ID NO: 3207 - DNA, 32 bp, Artificial Sequence
  Synthetic polynucleotide
ttttcctacatggaatgtacagttcctgacat

SEQ ID NO: 3208 - DNA, 32 bp, Artificial Sequence
  Synthetic polynucleotide
ttttttttgttaaaaaggtcagaatttttttt

SEQ ID NO: 3209 - DNA, 32 bp, Artificial Sequence
  Synthetic polynucleotide
ttttttttcccagcggagtagttttttttttt

SEQ ID NO: 3210 - DNA, 32 bp, Artificial Sequence
  Synthetic polynucleotide
ttttttttatgtcaggctgctttttttttttt

SEQ ID NO: 3211 - DNA, 48 bp, Artificial Sequence
  Synthetic polynucleotide
ttttttttaaccgtgagtatgattgccccctatttcggagtcacctaa

SEQ ID NO: 3212 - DNA, 48 bp, Artificial Sequence
  Synthetic polynucleotide
ttttttttctgtttacaattctcattaagtatgaatatccccggttga

SEQ ID NO: 3213 - DNA, 48 bp, Artificial Sequence
  Synthetic polynucleotide
gactattgaaacgtcccccaaatgcgccagggtaggtatgtttttttt

SEQ ID NO: 3214 - DNA, 32 bp, Artificial Sequence; identical to SEQ ID NO: 47
  Synthetic polynucleotide

SEQ ID NO: 3215 - DNA, 32 bp, Artificial Sequence
  Synthetic polynucleotide
tttgtccatgcctgtacaatagtcgtgaccga

SEQ ID NO: 3216 - DNA, 32 bp, Artificial Sequence
  Synthetic polynucleotide
catacctaccctggcgccttcatcacggactt

SEQ ID NO: 3217 - DNA, 32 bp, Artificial Sequence
  Synthetic polynucleotide
tttttttttcggtcacagattgtatttttttt

SEQ ID NO: 3218 - DNA, 32 bp, Artificial Sequence
  Synthetic polynucleotide
ttttttttctaatacgtggacaaatttttttt

SEQ ID NO: 3219 - DNA, 32 bp, Artificial Sequence
  Synthetic polynucleotide
ttttttttaagtccgttattgctctttttttt

SEQ ID NO: 3220 - DNA, 48 bp, Artificial Sequence
  Synthetic polynucleotide
ttttttttccatccctaagtaaactatcccaagaggcagctacaggca

SEQ ID NO: 3221 - DNA, 48 bp, Artificial Sequence
  Synthetic polynucleotide
ttttttttcgcagggtgctatgctttatgtgactggtctctcaatttc

SEQ ID NO: 3222 - DNA, 48 bp, Artificial Sequence
  Synthetic polynucleotide
tcggtgacacctatacgattcgcgattgatccacctcgcctttttttt

SEQ ID NO: 3223 - DNA, 32 bp, Artificial Sequence; identical to SEQ ID NO: 56
  Synthetic polynucleotide

SEQ ID NO: 3224 - DNA, 32 bp, Artificial Sequence
  Synthetic polynucleotide
tgggtattgaaatcccgtcaccgaggttttct

SEQ ID NO: 3225 - DNA, 32 bp, Artificial Sequence
  Synthetic polynucleotide
ggcgaggtggatcaatcaaacgccgagcgttg

SEQ ID NO: 3226 - DNA, 32 bp, Artificial Sequence
  Synthetic polynucleotide
ttttttttagaaaacccctctccctttttttt

SEQ ID NO: 3227 - DNA, 32 bp, Artificial Sequence
  Synthetic polynucleotide
ttttttttggcgggcaaatacccatttttttt

SEQ ID NO: 3228 - DNA, 32 bp, Artificial Sequence
  Synthetic polynucleotide
ttttttttcaacgctctaacaaggtttttttt

SEQ ID NO: 3229 - DNA, 48 bp, Artificial Sequence
  Synthetic polynucleotide
tttttttttccggtttagcgaattcttgcctccagccttcgggatttc

SEQ ID NO: 3230 - DNA, 48 bp, Artificial Sequence
  Synthetic polynucleotide
ttttttttcccgagccaggtggcctaggcggacggcgccgtgccatcg

SEQ ID NO: 3231 - DNA, 48 bp, Artificial Sequence
  Synthetic polynucleotide
cctatcactaagaccttgtaaacagctaaatcaggcgtcgtttttttt

SEQ ID NO: 3232 - DNA, 32 bp, Artificial Sequence; identical to SEQ ID NO: 75
  Synthetic polynucleotide

SEQ ID NO: 3233 - DNA, 32 bp, Artificial Sequence; identical to SEQ ID NO: 1274
  Synthetic polynucleotide

SEQ ID NO: 3234 - DNA, 32 bp, Artificial Sequence
  Synthetic polynucleotide
cgacgcctgatttagcaggaatgtattataaa

SEQ ID NO: 3235 - DNA, 32 bp, Artificial Sequence
  Synthetic polynucleotide
ttttttttgctgagagcagcccattttttttt

SEQ ID NO: 3236 - DNA, 32 bp, Artificial Sequence
  Synthetic polynucleotide
tttttttttggttaggttatgtcgtttttttt

SEQ ID NO: 3237 - DNA, 32 bp, Artificial Sequence
  Synthetic polynucleotide
tttttttttttataatgccaaaattttttttt

SEQ ID NO: 3238 - DNA, 48 bp, Artificial Sequence
  Synthetic polynucleotide
tttttttttaagcgttacaggcggttccgcccacgttgttacggctag

SEQ ID NO: 3239 - DNA, 48 bp, Artificial Sequence
  Synthetic polynucleotide
ttttttttggttggttactgtacgcgaaggtccgtcctgtcccgttcc

SEQ ID NO: 3240 - DNA, 48 bp, Artificial Sequence
  Synthetic polynucleotide
ggtcacacggctatacgttgaccttacagaattcaggagttttttttt

SEQ ID NO: 3241 - DNA, 32 bp, Artificial Sequence; identical to SEQ ID NO: 1976
  Synthetic polynucleotide

SEQ ID NO: 3242 - DNA, 32 bp, Artificial Sequence
  Synthetic polynucleotide
ctagaacgttgccaccgtgtgaccatagcgct

SEQ ID NO: 3243 - DNA, 32 bp, Artificial Sequence
  Synthetic polynucleotide
actcctgaattctgtacctggttaaagaaacg

SEQ ID NO: 3244 - DNA, 32 bp, Artificial Sequence
  Synthetic polynucleotide
ttttttttagcgctattgtgggcttttttttt

SEQ ID NO: 3245 - DNA, 32 bp, Artificial Sequence
  Synthetic polynucleotide
ttttttttgaatcttacgttctagtttttttt

SEQ ID NO: 3246 - DNA, 32 bp, Artificial Sequence
  Synthetic polynucleotide
ttttttttcgtttcttgtgctgcgtttttttt

SEQ ID NO: 3247 - DNA, 48 bp, Artificial Sequence
  Synthetic polynucleotide
ttttttttgtgggacgtatgattgcgacatcccccaataaggtggcaa

SEQ ID NO: 3248 - DNA, 48 bp, Artificial Sequence
  Synthetic polynucleotide
ttttttttaaagatactgtactacaggctgcgcgggtataggagcgta

SEQ ID NO: 3249 - DNA, 16 bp, Artificial Sequence
  Synthetic polynucleotide
ttcttaaatttttttt

SEQ ID NO: 3250 - DNA, 16 bp, Artificial Sequence
  Synthetic polynucleotide
ttggctgatttttttt

SEQ ID NO: 3251 - DNA, 16 bp, Artificial Sequence
  Synthetic polynucleotide
ttttttttccgcgtaa

SEQ ID NO: 3252 - DNA, 16 bp, Artificial Sequence
  Synthetic polynucleotide
ttttttttccaacagg

SEQ ID NO: 3253 - DNA, 32 bp, Artificial Sequence
  Synthetic polynucleotide
tatggtgatttttttttttttttttggcaccc

SEQ ID NO: 3254 - DNA, 32 bp, Artificial Sequence
  Synthetic polynucleotide
atccgaagttttttttttttttttcgcggaca

SEQ ID NO: 3255 - DNA, 48 bp, Artificial Sequence
  Synthetic polynucleotide
cgctgatcttttttttttttttttggggatgaatccttccaacatctc

SEQ ID NO: 3256 - DNA, 48 bp, Artificial Sequence
  Synthetic polynucleotide
tctgatatttttttttttttttttgcactgcccctactctcacctttc

SEQ ID NO: 3257 - DNA, 16 bp, Artificial Sequence
  Synthetic polynucleotide
atatcagagagcacag

SEQ ID NO: 3258 - DNA, 16 bp, Artificial Sequence
  Synthetic polynucleotide
tccgggatgggtgcca

SEQ ID NO: 3259 - DNA, 16 bp, Artificial Sequence
  Synthetic polynucleotide
agagtctggagatgat

SEQ ID NO: 3260 - DNA, 16 bp, Artificial Sequence
  Synthetic polynucleotide
gcttcgcgcctgttgg

SEQ ID NO: 3261 - DNA, 32 bp, Artificial Sequence
  Synthetic polynucleotide
taatataatgtccgcggatcagcgaattcgac

SEQ ID NO: 3262 - DNA, 32 bp, Artificial Sequence
  Synthetic polynucleotide
agttagcattacgcgggtaccctggaccgcta

SEQ ID NO: 3263 - DNA, 48 bp, Artificial Sequence
  Synthetic polynucleotide
ggaaggattcatcccctttaagaatgatcgcaccaggttaagtggctc

SEQ ID NO: 3264 - DNA, 48 bp, Artificial Sequence
  Synthetic polynucleotide
tacatctcgctcgtcctcaccataatccaccacccatgcagaaagata

SEQ ID NO: 3265 - DNA, 32 bp, Artificial Sequence
  Synthetic polynucleotide
gtgcgcttctgtgctcatcccttgctcccgaa

SEQ ID NO: 3266 - DNA, 32 bp, Artificial Sequence
  Synthetic polynucleotide
tccctaaagtcgaattgagatgtaagtttcac

SEQ ID NO: 3267 - DNA, 48 bp, Artificial Sequence
  Synthetic polynucleotide
accttttaatcatctccagactctttttttttttttttttgagccgat

SEQ ID NO: 3268 - DNA, 48 bp, Artificial Sequence
  Synthetic polynucleotide
gggagatttagcggtccagggtacttttttttttttttttggacgagc

SEQ ID NO: 3269 - DNA, 32 bp, Artificial Sequence; identical to SEQ ID NO: 21
  Synthetic polynucleotide

SEQ ID NO: 3270 - DNA, 32 bp, Artificial Sequence
  Synthetic polynucleotide
aaggtaatgtgaaactcaatgatatgacggat

SEQ ID NO: 3271 - DNA, 48 bp, Artificial Sequence
  Synthetic polynucleotide
acatctcggaaaggtgagagtaggggcagtgctcagccaaacagtggg

SEQ ID NO: 3272 - DNA, 48 bp, Artificial Sequence
  Synthetic polynucleotide
cttacactttcgggagcaagggatatcggctccttcggattctctggc

SEQ ID NO: 3273 - DNA, 48 bp, Artificial Sequence
  Synthetic polynucleotide
tatcattggccagagatgctaactgtatgacggaccaggtctcctagg

SEQ ID NO: 3274 - DNA, 48 bp, Artificial Sequence
  Synthetic polynucleotide
tgcatgggtggtggatcgcgaagctgtcgtgaatgatcggtcatatgt

SEQ ID NO: 3275 - DNA, 48 bp, Artificial Sequence
  Synthetic polynucleotide
acaatggtatcttttgaagcgcacgtaaaccgtaattcggagcccggc

SEQ ID NO: 3276 - DNA, 48 bp, Artificial Sequence
  Synthetic polynucleotide
acctggtccgtcatactaaaaggtagaagtaagtagggtaccgctggg

SEQ ID NO: 3277 - DNA, 32 bp, Artificial Sequence
  Synthetic polynucleotide
gctcttaatatctttcggttgcgggagtaagg

SEQ ID NO: 3278 - DNA, 32 bp, Artificial Sequence
  Synthetic polynucleotide
gtttagtgatccgtcaaccattgttattggcc

SEQ ID NO: 3279 - DNA, 48 bp, Artificial Sequence
  Synthetic polynucleotide
caccagaagagccacttaacctggtgcgatcaatcccggacacgtaaa

SEQ ID NO: 3280 - DNA, 48 bp, Artificial Sequence
  Synthetic polynucleotide
ccacaaagtcttgtataaagactgtgcgagatctttacgcgcttgaac

SEQ ID NO: 3281 - DNA, 48 bp, Artificial Sequence
  Synthetic polynucleotide
ttccttttcaaccaaaagatgttccccactgtttatattacaaaagat

SEQ ID NO: 3282 - DNA, 48 bp, Artificial Sequence
  Synthetic polynucleotide
ccgaattacggtttaccgagatgtttacttgcacttgggattaggatc

SEQ ID NO: 3283 - DNA, 32 bp, Artificial Sequence
  Synthetic polynucleotide
cttgcctgggccaatactttgtggtccactat

SEQ ID NO: 3284 - DNA, 32 bp, Artificial Sequence
  Synthetic polynucleotide
cagtccgacctaggagcggtctggctgtgagg

SEQ ID NO: 3285 - DNA, 48 bp, Artificial Sequence
  Synthetic polynucleotide
gcgtaaagatctcgcattctggtgccaaaactaatcatactcacggtt

SEQ ID NO: 3286 - DNA, 48 bp, Artificial Sequence; identical to SEQ ID NO: 2956
  Synthetic polynucleotide

SEQ ID NO: 3287 - DNA, 48 bp, Artificial Sequence
  Synthetic polynucleotide
gtgctcttgagcggtgttaagagcctcgcttcaagtccgtgtcggtag

SEQ ID NO: 3288 - DNA, 48 bp, Artificial Sequence
  Synthetic polynucleotide
aaaacttcacatatgaccgatcattcacgacaaatctcccgctagatg

SEQ ID NO: 3289 - DNA, 32 bp, Artificial Sequence
  Synthetic polynucleotide
gggagctggccgggctattacttttgccatat

SEQ ID NO: 3290 - DNA, 32 bp, Artificial Sequence
  Synthetic polynucleotide
gttgttccatagtggaaagagcacgttaactc

SEQ ID NO: 3291 - DNA, 48 bp, Artificial Sequence
  Synthetic polynucleotide
gtagtttacccagcggtaccctacttacttctagtgtaagcaacccat

SEQ ID NO: 3292 - DNA, 48 bp, Artificial Sequence
  Synthetic polynucleotide
cgactcaacctcacagccagaccgcatctagcattaccttcaccgctc

SEQ ID NO: 3293 - DNA, 32 bp, Artificial Sequence; identical to SEQ ID NO: 23
  Synthetic polynucleotide

SEQ ID NO: 3294 - DNA, 32 bp, Artificial Sequence
  Synthetic polynucleotide
actgaggcgagttaacttatgttctaacctgc

SEQ ID NO: 3295 - DNA, 48 bp, Artificial Sequence
  Synthetic polynucleotide
tcatgtgggatcctaatcccaagtgcaagtaaaaaaggaattatgaga

SEQ ID NO: 3296 - DNA, 48 bp, Artificial Sequence
  Synthetic polynucleotide
gatcacaaatatggcaaaagtaatatgggttgcactaaactatagcaa

SEQ ID NO: 3297 - DNA, 48 bp, Artificial Sequence
  Synthetic polynucleotide
gaacataattgctatatcggactgtgggcgtacctacaccacagatgc

SEQ ID NO: 3298 - DNA, 48 bp, Artificial Sequence
  Synthetic polynucleotide
acggacttgaagcgaggaagttttgcgactcattgctgagttcgacgc

SEQ ID NO: 3299 - DNA, 48 bp, Artificial Sequence
  Synthetic polynucleotide
atataggtctgacacccagctcccaggtaagtgtattatcgcgtcaat

SEQ ID NO: 3300 - DNA, 48 bp, Artificial Sequence
  Synthetic polynucleotide
ggtgtaggtacgcccataaactacttttccacgttgccctcgaccgat

SEQ ID NO: 3301 - DNA, 32 bp, Artificial Sequence
  Synthetic polynucleotide
ggagggttctaccgacatattgctttgccctt

SEQ ID NO: 3302 - DNA, 32 bp, Artificial Sequence
  Synthetic polynucleotide
tgttgagggcaggttaacctatatagccattt

SEQ ID NO: 3303 - DNA, 48 bp, Artificial Sequence
  Synthetic polynucleotide
agcttgggaaccgtgagtatgattagttttggctgctgaatgtccgtg

SEQ ID NO: 3304 - DNA, 48 bp, Artificial Sequence
  Synthetic polynucleotide
cgaccatttgacacccgagtcggcctgacagacatcttttggggtcgt

SEQ ID NO: 3305 - DNA, 48 bp, Artificial Sequence
  Synthetic polynucleotide
agcctacgatagccagataatagttctcataacaggcaagggtgtcag

SEQ ID NO: 3306 - DNA, 48 bp, Artificial Sequence
  Synthetic polynucleotide
gataatacacttacctccacatgaaggtctaccagaaactatgtaccg

SEQ ID NO: 3307 - DNA, 32 bp, Artificial Sequence; identical to SEQ ID NO: 2022
  Synthetic polynucleotide

SEQ ID NO: 3308 - DNA, 32 bp, Artificial Sequence
  Synthetic polynucleotide
cgtccagcgcatctgtgatccacgtcagattt

SEQ ID NO: 3309 - DNA, 48 bp, Artificial Sequence
  Synthetic polynucleotide
aaaagatgtctgtcagcccaagcttagcataaaactgttgtgtcctat

SEQ ID NO: 3310 - DNA, 48 bp, Artificial Sequence; identical to SEQ ID NO: 2968
  Synthetic polynucleotide

SEQ ID NO: 3311 - DNA, 48 bp, Artificial Sequence
  Synthetic polynucleotide
gcgtatgctgaaatggaaccctcctacgttttgcgatggtgatgggaa

SEQ ID NO: 3312 - DNA, 48 bp, Artificial Sequence
  Synthetic polynucleotide
tttagtttgcgtcgaactcagcaatgagtcgcttgagtcggtggataa

SEQ ID NO: 3313 - DNA, 32 bp, Artificial Sequence
  Synthetic polynucleotide
atcgctcaattgacgcgactttgtgtaatctc

SEQ ID NO: 3314 - DNA, 32 bp, Artificial Sequence
  Synthetic polynucleotide
catacacacatattgtgcatacgccctggttt

SEQ ID NO: 3315 - DNA, 48 bp, Artificial Sequence
  Synthetic polynucleotide
ctgagcgtatcggtcgagggcaacgtggaaaattgtgatcccctccca

SEQ ID NO: 3316 - DNA, 48 bp, Artificial Sequence
  Synthetic polynucleotide
aataggctattcaagagctggacgtgcgcgaggcacgtatgtcttgag

SEQ ID NO: 3317 - DNA, 48 bp, Artificial Sequence
  Synthetic polynucleotide
tagggctaaaatctgacgtggatcttatccacgcctcagtccatttca

SEQ ID NO: 3318 - DNA, 48 bp, Artificial Sequence
  Synthetic polynucleotide
accatcgcaaaacgtaaaactaaatgacgtttgaggtgatacgtaaag

SEQ ID NO: 3319 - DNA, 32 bp, Artificial Sequence
  Synthetic polynucleotide
gcggctggacgaccccgccgtgcgacgactga

SEQ ID NO: 3320 - DNA, 32 bp, Artificial Sequence
  Synthetic polynucleotide
gtaatgcgaaaccaggagcctattcatcaagg

SEQ ID NO: 3321 - DNA, 48 bp, Artificial Sequence
  Synthetic polynucleotide
gatatccacggtacatagtttctggtagacctcgtaggctagagcggt

SEQ ID NO: 3322 - DNA, 48 bp, Artificial Sequence
  Synthetic polynucleotide
tattaagttttcgccgtgagcgatcaatgacctcatatggacacacca

SEQ ID NO: 3323 - DNA, 48 bp, Artificial Sequence
  Synthetic polynucleotide
gatcctgagagattacacaaagtctgggagggcctcaacatcttgaat

SEQ ID NO: 3324 - DNA, 48 bp, Artificial Sequence
  Synthetic polynucleotide
atacgtgcctcgcgcaacgctcagccggtctgtagggtgacgtattag

SEQ ID NO: 3325 - DNA, 32 bp, Artificial Sequence
  Synthetic polynucleotide
caaatcccttcccatcaaatacgactaagccg

SEQ ID NO: 3326 - DNA, 32 bp, Artificial Sequence
  Synthetic polynucleotide
cgttgcacccttgatgacttaatattcaggct

SEQ ID NO: 3327 - DNA, 48 bp, Artificial Sequence
  Synthetic polynucleotide
cgtttgtcataggacacaacagttttatgctaacttggaccgggcatc

SEQ ID NO: 3328 - DNA, 48 bp, Artificial Sequence
  Synthetic polynucleotide
gcagggtgaaagtgagccagccgcgcgcagggctcgacggttaatttg

SEQ ID NO: 3329 - DNA, 48 bp, Artificial Sequence
  Synthetic polynucleotide
actctcgttcagtcgtcgcacggcaccgctctctctccgccggcgaaa

SEQ ID NO: 3330 - DNA, 48 bp, Artificial Sequence
  Synthetic polynucleotide
ccatatgaggtcattgtggatatctccgtgcagtaaacgataggtttc

SEQ ID NO: 3331 - DNA, 32 bp, Artificial Sequence
  Synthetic polynucleotide
ccagtaatagcctgaacaccctgcatcgacgg

SEQ ID NO: 3332 - DNA, 32 bp, Artificial Sequence; identical to SEQ ID NO: 1356
  Synthetic polynucleotide

SEQ ID NO: 3333 - DNA, 48 bp, Artificial Sequence
  Synthetic polynucleotide
ccgtcgagccctgcgcgacaaacgcatatcctgtttacttagggatgg

SEQ ID NO: 3334 - DNA, 48 bp, Artificial Sequence; identical to SEQ ID NO: 2980
  Synthetic polynucleotide

SEQ ID NO: 3335 - DNA, 48 bp, Artificial Sequence
  Synthetic polynucleotide
gaaagatcataacgttgggatttgttccgcctataggtaactgggttt

SEQ ID NO: 3336 - DNA, 48 bp, Artificial Sequence
  Synthetic polynucleotide
gtcaatttctttacgtatcacctcaaacgtcatagccctacggatcaa

SEQ ID NO: 3337 - DNA, 32 bp, Artificial Sequence
  Synthetic polynucleotide
gaattatatggtgtgtccatatcaacaaaccc

SEQ ID NO: 3338 - DNA, 32 bp, Artificial Sequence
  Synthetic polynucleotide
gcggcgaaccgtcgatgatctttcggaccgag

SEQ ID NO: 3339 - DNA, 48 bp, Artificial Sequence
  Synthetic polynucleotide
ggcttgcactaatacgtcaccctacagaccggtcaggatcattttgga

SEQ ID NO: 3340 - DNA, 48 bp, Artificial Sequence
  Synthetic polynucleotide
tttgtaaacttacctaattcccagttgatccgcgcattacaacgttat

SEQ ID NO: 3341 - DNA, 32 bp, Artificial Sequence; identical to SEQ ID NO: 28
  Synthetic polynucleotide

SEQ ID NO: 3342 - DNA, 32 bp, Artificial Sequence; identical to SEQ ID NO: 1246
  Synthetic polynucleotide

SEQ ID NO: 3343 - DNA, 48 bp, Artificial Sequence
  Synthetic polynucleotide
aagcaagagaaacctatcgtttactgcacggaacgagagtgctggcat

SEQ ID NO: 3344 - DNA, 48 bp, Artificial Sequence
  Synthetic polynucleotide
tgggcccggggtttgttgatatggtccaaaatgtgcaacgggaaacac

SEQ ID NO: 3345 - DNA, 48 bp, Artificial Sequence
  Synthetic polynucleotide
ctcgaattgtgtttccatgctagcgccacacgactacttaagacttag

SEQ ID NO: 3346 - DNA, 48 bp, Artificial Sequence
  Synthetic polynucleotide
ttacctataggcggaaaaattgacatttctacaatcgtgacggtttct

SEQ ID NO: 3347 - DNA, 48 bp, Artificial Sequence
  Synthetic polynucleotide
cttctacctcttaatgtataattcatcctgtggattacggcggcttag

SEQ ID NO: 3348 - DNA, 48 bp, Artificial Sequence
  Synthetic polynucleotide
taagtagtcgtgtggctgcaagccctcacctgacctcttagcacaata

SEQ ID NO: 3349 - DNA, 32 bp, Artificial Sequence
  Synthetic polynucleotide
cctaacataaacccagcgtgacggtgaatctt

SEQ ID NO: 3350 - DNA, 32 bp, Artificial Sequence
  Synthetic polynucleotide
gtgtaagagggacatgggtagaaggaactctg

SEQ ID NO: 3351 - DNA, 48 bp, Artificial Sequence
  Synthetic polynucleotide
attaccgtccatccctaagtaaacaggatatggcgccagaccacaatg

SEQ ID NO: 3352 - DNA, 48 bp, Artificial Sequence
  Synthetic polynucleotide
gccgatggaaaacgacgcgggccgggaaggacctttaggcccaaggag

SEQ ID NO: 3353 - DNA, 48 bp, Artificial Sequence
  Synthetic polynucleotide
tcgcaacggaagcgtaatcgactaatgccagcattactggcattaaga

SEQ ID NO: 3354 - DNA, 48 bp, Artificial Sequence
  Synthetic polynucleotide
ccgtaatccacaggattcttgcttatcttagtccccaagtgctacatg

SEQ ID NO: 3355 - DNA, 32 bp, Artificial Sequence
  Synthetic polynucleotide
catggaagcagagttcccatcggcaaaattga

SEQ ID NO: 3356 - DNA, 32 bp, Artificial Sequence
  Synthetic polynucleotide
aaccgcgcctaagtctttagaatcaccttagg

SEQ ID NO: 3357 - DNA, 48 bp, Artificial Sequence
  Synthetic polynucleotide
gcctaaaggtccttccacggtaatcgggggtgtacgaactcaacgcac

SEQ ID NO: 3358 - DNA, 48 bp, Artificial Sequence; identical to SEQ ID NO: 2992
  Synthetic polynucleotide

SEQ ID NO: 3359 - DNA, 48 bp, Artificial Sequence
  Synthetic polynucleotide
cgacctctagatcccaatgttaggagctaacagatatttcaaggacac

SEQ ID NO: 3360 - DNA, 48 bp, Artificial Sequence
  Synthetic polynucleotide
tcttcaaaagaaaccgtcacgattgtagaaattttacaaagacggaca

SEQ ID NO: 3361 - DNA, 32 bp, Artificial Sequence
  Synthetic polynucleotide
aatgttctctaagccgagtaaacaatcaagga

SEQ ID NO: 3362 - DNA, 32 bp, Artificial Sequence
  Synthetic polynucleotide
gaagaggttcaattttagaggtcgaggcgagt

SEQ ID NO: 3363 - DNA, 48 bp, Artificial Sequence
  Synthetic polynucleotide
gtaggctctattgtgctaagaggtcaggtgagcgggcccaattgtacc

SEQ ID NO: 3364 - DNA, 48 bp, Artificial Sequence
  Synthetic polynucleotide
acggaaactcctacccgcgcggttgatgtgcctgcgaaaagcaagccg

SEQ ID NO: 3365 - DNA, 48 bp, Artificial Sequence
  Synthetic polynucleotide
gtggcggacctaaggtgattctaatgtccgtcaatgagcttgggatct

SEQ ID NO: 3366 - DNA, 48 bp, Artificial Sequence
  Synthetic polynucleotide
gaaatatctgttagcttttgaagaaggctccgtcattccgtcccccaa

SEQ ID NO: 3367 - DNA, 32 bp, Artificial Sequence; identical to SEQ ID NO: 31
  Synthetic polynucleotide

SEQ ID NO: 3368 - DNA, 32 bp, Artificial Sequence; identical to SEQ ID NO: 1248
  Synthetic polynucleotide

SEQ ID NO: 3369 - DNA, 48 bp, Artificial Sequence
  Synthetic polynucleotide
gcgattcgcatgtagcacttggggactaagatcgttgcgaattttcgc

SEQ ID NO: 3370 - DNA, 48 bp, Artificial Sequence
  Synthetic polynucleotide
gttaccgctataattaagaacattcgggttcggggaattgagtacaag

SEQ ID NO: 3371 - DNA, 48 bp, Artificial Sequence
  Synthetic polynucleotide
gcgcagtttccttgattgtttactggtacaattcttacacgggtagga

SEQ ID NO: 3372 - DNA, 48 bp, Artificial Sequence
  Synthetic polynucleotide
ttttcgcaggcacatcgagcctacccgtctatagcagaatggtataaa

SEQ ID NO: 3373 - DNA, 32 bp, Artificial Sequence
  Synthetic polynucleotide
cacctaccgtgtccttcgtcctgtcccgttcc

SEQ ID NO: 3374 - DNA, 32 bp, Artificial Sequence
  Synthetic polynucleotide
atattacaaagaacgcgcggtaacatcacata

SEQ ID NO: 3375 - DNA, 48 bp, Artificial Sequence
  Synthetic polynucleotide
cgagtcgtgtgcgttgagttcgtacacccccgaaactgaggagaacat

SEQ ID NO: 3376 - DNA, 48 bp, Artificial Sequence
  Synthetic polynucleotide
cctaggcgtaagacctgccggagtagacgtgccacgcgagctatgtag

SEQ ID NO: 3377 - DNA, 48 bp, Artificial Sequence
  Synthetic polynucleotide
cgtcgtcttgggtaagctaatatagcgaaaatcttccatgtaattata

SEQ ID NO: 3378 - DNA, 48 bp, Artificial Sequence
  Synthetic polynucleotide
caattccccgaacccgcgaatcgcaggacgatctcgttcgggtgctac

SEQ ID NO: 3379 - DNA, 32 bp, Artificial Sequence; identical to SEQ ID NO: 2027
  Synthetic polynucleotide

SEQ ID NO: 3380 - DNA, 32 bp, Artificial Sequence
  Synthetic polynucleotide
cggacacacggcttgctgcgaccaagttttat

SEQ ID NO: 3381 - DNA, 48 bp, Artificial Sequence
  Synthetic polynucleotide
ctcgcgtggcacgtctacgactcgtcgaacgagctcgggtagtctcaa

SEQ ID NO: 3382 - DNA, 48 bp, Artificial Sequence; identical to SEQ ID NO: 3002
  Synthetic polynucleotide

SEQ ID NO: 3383 - DNA, 48 bp, Artificial Sequence
  Synthetic polynucleotide
gccagacttttacggcggtaggtgtaagacctcgccctgacgtagaac

SEQ ID NO: 3384 - DNA, 48 bp, Artificial Sequence
  Synthetic polynucleotide
tagccgccttgggggacggaatgacggagccttccgccacccctgaca

SEQ ID NO: 3385 - DNA, 32 bp, Artificial Sequence
  Synthetic polynucleotide
gagctcaccttgtactcttatccttcaccagg

SEQ ID NO: 3386 - DNA, 32 bp, Artificial Sequence
  Synthetic polynucleotide
gcggatgcgaggttagagtctggcaacgggtt

SEQ ID NO: 3387 - DNA, 48 bp, Artificial Sequence
  Synthetic polynucleotide
tcccaatctttataccattctgctatagacggaactgcgcgtcactgc

SEQ ID NO: 3388 - DNA, 48 bp, Artificial Sequence
  Synthetic polynucleotide
agggattgagtacccatgtgtccgagatggcatatgacaggtgagcac

SEQ ID NO: 3389 - DNA, 48 bp, Artificial Sequence
  Synthetic polynucleotide
ttccgcgcataaaacttggtcgcatgtcaggggtcgggtcgccgtaaa

SEQ ID NO: 3390 - DNA, 48 bp, Artificial Sequence
  Synthetic polynucleotide
tcagggcgaggtcttaggcggctacgtctatttaacgtgcctgatcac

SEQ ID NO: 3391 - DNA, 32 bp, Artificial Sequence; identical to SEQ ID NO: 33
  Synthetic polynucleotide

SEQ ID NO: 3392 - DNA, 32 bp, Artificial Sequence
  Synthetic polynucleotide
tcagcggcaacccgttcaatccctagccgttc

SEQ ID NO: 3393 - DNA, 48 bp, Artificial Sequence
  Synthetic polynucleotide
gcatgccggtagcacccgaacgagatcgtcctagacgacggatctcct

SEQ ID NO: 3394 - DNA, 48 bp, Artificial Sequence
  Synthetic polynucleotide
atgactccaggagagggtgagctcctacgtggtgacgaagaataccgt

SEQ ID NO: 3395 - DNA, 48 bp, Artificial Sequence
  Synthetic polynucleotide
ataaccatcctggtgaaggataaggcagtgactgtaatattgggtact

SEQ ID NO: 3396 - DNA, 48 bp, Artificial Sequence
  Synthetic polynucleotide
ctgtcatatgccatctgattgggagagtccaggcaataaagaaactgc

SEQ ID NO: 3397 - DNA, 32 bp, Artificial Sequence
  Synthetic polynucleotide
ttcattacgttctacgcgatgcttttgccaca

SEQ ID NO: 3398 - DNA, 32 bp, Artificial Sequence
  Synthetic polynucleotide
cctacgccgaacggctggagtcatctcggcat

SEQ ID NO: 3399 - DNA, 48 bp, Artificial Sequence
  Synthetic polynucleotide
agtttcctttgagactacccgagctcgttcgagccaaaatcaaggacg

SEQ ID NO: 3400 - DNA, 48 bp, Artificial Sequence
  Synthetic polynucleotide
agttagatccatgcgaaacagtccgtatagcgcccagtgagctcgaca

SEQ ID NO: 3401 - DNA, 48 bp, Artificial Sequence
  Synthetic polynucleotide
gcgttaaaaacctcgtccaagtcaaggagatcgaccacgtcctctcct

SEQ ID NO: 3402 - DNA, 48 bp, Artificial Sequence
  Synthetic polynucleotide
cttcgtcaccacgtagcggcatgcagcacgcatatttgacgtcttgcg

SEQ ID NO: 3403 - DNA, 32 bp, Artificial Sequence; identical to SEQ ID NO: 1020
  Synthetic polynucleotide

SEQ ID NO: 3404 - DNA, 32 bp, Artificial Sequence
  Synthetic polynucleotide
cccgacctgtgctcacgcacgagaaggcttcc

SEQ ID NO: 3405 - DNA, 48 bp, Artificial Sequence
  Synthetic polynucleotide
tcactgggcgctatacaggaaactcgaggggcgaagatagagagcata

SEQ ID NO: 3406 - DNA, 48 bp, Artificial Sequence; identical to SEQ ID NO: 3016
  Synthetic polynucleotide

SEQ ID NO: 3407 - DNA, 48 bp, Artificial Sequence
  Synthetic polynucleotide
aagaatggtctacatcgtaatgaaggatagataagcagagcattttga

SEQ ID NO: 3408 - DNA, 48 bp, Artificial Sequence
  Synthetic polynucleotide
ttcagcgggtgatcaggcacgttaaatagacggcgcggaagacctccg

SEQ ID NO: 3409 - DNA, 32 bp, Artificial Sequence
  Synthetic polynucleotide
aagagcaaacggtattatcccgttcacagcgc

SEQ ID NO: 3410 - DNA, 32 bp, Artificial Sequence
  Synthetic polynucleotide
acatgaggaaaaatcaccattcttgtgccagt

SEQ ID NO: 3411 - DNA, 48 bp, Artificial Sequence
  Synthetic polynucleotide
ttaccctcgcagtttctttattgcctggactcatggttatcccttccc

SEQ ID NO: 3412 - DNA, 48 bp, Artificial Sequence
  Synthetic polynucleotide
ttaccagcgtgcggccaggtcgggacagcagtacccatggcgcaccac

SEQ ID NO: 3413 - DNA, 48 bp, Artificial Sequence
  Synthetic polynucleotide
tatttcctggaagccttctcgtgccggaggtcgccgctgagatgtaga

SEQ ID NO: 3414 - DNA, 48 bp, Artificial Sequence
  Synthetic polynucleotide
ctctgcttatctatccccgctgaaaggattattcaataatgcacctgc

SEQ ID NO: 3415 - DNA, 32 bp, Artificial Sequence; identical to SEQ ID NO: 35
  Synthetic polynucleotide

SEQ ID NO: 3416 - DNA, 32 bp, Artificial Sequence
  Synthetic polynucleotide
ttctagccactggcacgctggtaatctgggct

SEQ ID NO: 3417 - DNA, 48 bp, Artificial Sequence
  Synthetic polynucleotide
cagcttgacgcaagacgtcaaatatgcgtgcttttaacgctttagacc

SEQ ID NO: 3418 - DNA, 48 bp, Artificial Sequence
  Synthetic polynucleotide
attcagaatcgagaccttgctcttggacgtctccatcagatggagctg

SEQ ID NO: 3419 - DNA, 48 bp, Artificial Sequence
  Synthetic polynucleotide
tggaccacgcgctgtgaacgggatgggaagggggcgtaggggccgcac

SEQ ID NO: 3420 - DNA, 48 bp, Artificial Sequence
  Synthetic polynucleotide
ccatgggtactgctgtgagggtaacacgttggactcctactgcccgcc

SEQ ID NO: 3421 - DNA, 32 bp, Artificial Sequence
  Synthetic polynucleotide
ttcaacaatcaaaatgatattgtagcgagata

SEQ ID NO: 3422 - DNA, 32 bp, Artificial Sequence
  Synthetic polynucleotide
ctacatttagcccagattctgaatcgcgggct

SEQ ID NO: 3423 - DNA, 48 bp, Artificial Sequence
  Synthetic polynucleotide
aactactgtatgctctctatcttcgcccctcgcatcttaaatataact

SEQ ID NO: 3424 - DNA, 48 bp, Artificial Sequence
  Synthetic polynucleotide
ctagtaaccgaccgttgacagggaccaccgcatctttctcgtatatca

SEQ ID NO: 3425 - DNA, 48 bp, Artificial Sequence
  Synthetic polynucleotide
ctaggacccagaagtggtcgctggggtctaaataacacttggtctcga

SEQ ID NO: 3426 - DNA, 48 bp, Artificial Sequence
  Synthetic polynucleotide
tctgatggagacgtcctcaagctgctgcccagtgattagcgcttaggg

SEQ ID NO: 3427 - DNA, 32 bp, Artificial Sequence; identical to SEQ ID NO: 2031
  Synthetic polynucleotide

SEQ ID NO: 3428 - DNA, 32 bp, Artificial Sequence
  Synthetic polynucleotide
gatgatctgtggtgcgcacaatttgctggaag

SEQ ID NO: 3429 - DNA, 48 bp, Artificial Sequence
  Synthetic polynucleotide
gagaaagatgcggtggcagtagttgtgattagaattcgctaaaccgga

SEQ ID NO: 3430 - DNA, 48 bp, Artificial Sequence; identical to SEQ ID NO: 3028
  Synthetic polynucleotide

SEQ ID NO: 3431 - DNA, 48 bp, Artificial Sequence
  Synthetic polynucleotide
attaagctgtggaatgttgttgaacatactcctcattagggtccaccg

SEQ ID NO: 3432 - DNA, 48 bp, Artificial Sequence
  Synthetic polynucleotide
ttcctaacgcaggtgcattattgaataatcctaggaaataccactgcc

SEQ ID NO: 3433 - DNA, 32 bp, Artificial Sequence
  Synthetic polynucleotide
agggttcacagctccaaagcctgtcgaggcgt

SEQ ID NO: 3434 - DNA, 32 bp, Artificial Sequence
  Synthetic polynucleotide
gactctctcaaggcgcagcttaattagtaagg

SEQ ID NO: 3435 - DNA, 48 bp, Artificial Sequence
  Synthetic polynucleotide
tgttttaaggcgggcagtaggagtccaacgtggtggtccacggcgacg

SEQ ID NO: 3436 - DNA, 48 bp, Artificial Sequence
  Synthetic polynucleotide
cttttctgcttccagcaaattgtgggcagtggggctagaacattccac

SEQ ID NO: 3437 - DNA, 32 bp, Artificial Sequence; identical to SEQ ID NO: 37
  Synthetic polynucleotide

SEQ ID NO: 3438 - DNA, 32 bp, Artificial Sequence
  Synthetic polynucleotide
gtcctatcccttactagcggtacacaccaaga

SEQ ID NO: 3439 - DNA, 48 bp, Artificial Sequence
  Synthetic polynucleotide
aacctaccccctaagcgctaatcactgggcagggtcctaggttgcaga

SEQ ID NO: 3440 - DNA, 48 bp, Artificial Sequence
  Synthetic polynucleotide
ttacagcgacgcctcgacaggcttcgtcgccgaaatgtagccatgaat

SEQ ID NO: 3441 - DNA, 48 bp, Artificial Sequence
  Synthetic polynucleotide
tgtaccgcattcatggagatcatccattgacgtcgttacggggttaga

SEQ ID NO: 3442 - DNA, 48 bp, Artificial Sequence
  Synthetic polynucleotide
cctaatgaggagtatggttaggaatacctgctcctgaatgtccatgta

SEQ ID NO: 3443 - DNA, 48 bp, Artificial Sequence
  Synthetic polynucleotide
ctcctacgctcaatagtgaacccttactatcgtcaggcttctccgtca

SEQ ID NO: 3444 - DNA, 48 bp, Artificial Sequence
  Synthetic polynucleotide
cgtaacgacgtcaatgttaaaacaacaaccgatcagagttcccaccac

SEQ ID NO: 3445 - DNA, 32 bp, Artificial Sequence
  Synthetic polynucleotide
gtagatcccggtggacagaactcttgatgtcc

SEQ ID NO: 3446 - DNA, 32 bp, Artificial Sequence
  Synthetic polynucleotide
ggtcggattcttggtgcgtaggagttgaccta

SEQ ID NO: 3447 - DNA, 48 bp, Artificial Sequence
  Synthetic polynucleotide
tggagttatccggtttagcgaattctaatcacggcggatatggctggt

SEQ ID NO: 3448 - DNA, 48 bp, Artificial Sequence
  Synthetic polynucleotide
cgtttattagggctgccccccaagacgcttagtcacattagaatatgg

SEQ ID NO: 3449 - DNA, 48 bp, Artificial Sequence
  Synthetic polynucleotide
ggaacttggaaggagtttagtgagtctgcaacatagaatgctattgag

SEQ ID NO: 3450 - DNA, 48 bp, Artificial Sequence
  Synthetic polynucleotide
aagcctgacgatagtaggtaggtttaacccttactacgctggactcat

SEQ ID NO: 3451 - DNA, 32 bp, Artificial Sequence; identical to SEQ ID NO: 2033
  Synthetic polynucleotide

SEQ ID NO: 3452 - DNA, 32 bp, Artificial Sequence
  Synthetic polynucleotide
tgtttgcttctaacccggctacgagtggtctg

SEQ ID NO: 3453 - DNA, 48 bp, Artificial Sequence
  Synthetic polynucleotide
taatgtgactaagcgttaactccaaaggaaacaaagtatccgcatctc

SEQ ID NO: 3454 - DNA, 48 bp, Artificial Sequence; identical to SEQ ID NO: 3040
  Synthetic polynucleotide

SEQ ID NO: 3455 - DNA, 48 bp, Artificial Sequence
  Synthetic polynucleotide
accaatgtaagcagatggatctaccggcatgccggcgatttaatttgt

SEQ ID NO: 3456 - DNA, 48 bp, Artificial Sequence
  Synthetic polynucleotide
gagtgcgttacatggacattcaggagcaggtacagaaaaggaaccgac

SEQ ID NO: 3457 - DNA, 32 bp, Artificial Sequence
  Synthetic polynucleotide
agtctacgtgacggagtgacagaacacccgcc

SEQ ID NO: 3458 - DNA, 32 bp, Artificial Sequence
  Synthetic polynucleotide
cccgcgtattaagtatacattggttgtaaagg

SEQ ID NO: 3459 - DNA, 48 bp, Artificial Sequence
  Synthetic polynucleotide
ggctcccggtggtgggaactctgatcggttgtcgctgtaagtagacat

SEQ ID NO: 3460 - DNA, 48 bp, Artificial Sequence
  Synthetic polynucleotide
tttcggagtccccccaagcaaacagttccttcatactgtcggaagacc

SEQ ID NO: 3461 - DNA, 48 bp, Artificial Sequence
  Synthetic polynucleotide
catggagtcagaccactcgtagccgtcggttcgataggacatctgctt

SEQ ID NO: 3462 - DNA, 48 bp, Artificial Sequence
  Synthetic polynucleotide
aatcgccggcatgccgacgcactcacgccgagagacttattgacagcc

SEQ ID NO: 3463 - DNA, 32 bp, Artificial Sequence; identical to SEQ ID NO: 39
  Synthetic polynucleotide

SEQ ID NO: 3464 - DNA, 32 bp, Artificial Sequence
  Synthetic polynucleotide
ctcctgaccctttacactccgaaatggaagtg

SEQ ID NO: 3465 - DNA, 48 bp, Artificial Sequence
  Synthetic polynucleotide
ctgtacgaatgagtccagcgtagtaagggttacaagttcctgcggcgg

SEQ ID NO: 3466 - DNA, 48 bp, Artificial Sequence
  Synthetic polynucleotide
agctctagaggggaaccgtagacttcacataaaaatgttggctgagat

SEQ ID NO: 3467 - DNA, 48 bp, Artificial Sequence
  Synthetic polynucleotide
ttatgaaaggcgggtgttctgtcaatgtctacatccgacctgggggga

SEQ ID NO: 3468 - DNA, 48 bp, Artificial Sequence
  Synthetic polynucleotide
gacagtatgaaggaaccgggagcctcgggggatgttgaacgttgctaa

SEQ ID NO: 3469 - DNA, 32 bp, Artificial Sequence
  Synthetic polynucleotide
tgagattaacaaattacagagatgaacggttt

SEQ ID NO: 3470 - DNA, 32 bp, Artificial Sequence
  Synthetic polynucleotide
tgattgagcacttccactagagctactcgccg

SEQ ID NO: 3471 - DNA, 48 bp, Artificial Sequence
  Synthetic polynucleotide
gtttgaacgagatgcggatactttgtttcctttacgatgacgtcgagg

SEQ ID NO: 3472 - DNA, 48 bp, Artificial Sequence
  Synthetic polynucleotide
cctagaacctccattggatagctgggatatcgggcgcatatgagcttt

SEQ ID NO: 3473 - DNA, 48 bp, Artificial Sequence
  Synthetic polynucleotide
gtgggagagatgtccgcttacatcccgccgcatcctgtcggttcccct

SEQ ID NO: 3474 - DNA, 48 bp, Artificial Sequence
  Synthetic polynucleotide
caacatttttatgtgatcgtacagatgtcatgtcaaggcccgacatcc

SEQ ID NO: 3475 - DNA, 32 bp, Artificial Sequence
  Synthetic polynucleotide
aaaacactcggcgagtgttctagggagcgggg

SEQ ID NO: 3476 - DNA, 32 bp, Artificial Sequence
  Synthetic polynucleotide
gcagtcccggtcttccctgcaagaatgcatga

SEQ ID NO: 3477 - DNA, 48 bp, Artificial Sequence
  Synthetic polynucleotide
tatgcgcccgatatccgttcaaactagggggcactcagtgatcgagta

SEQ ID NO: 3478 - DNA, 48 bp, Artificial Sequence; identical to SEQ ID NO: 3052
  Synthetic polynucleotide

SEQ ID NO: 3479 - DNA, 48 bp, Artificial Sequence
  Synthetic polynucleotide
aaactactttaggtgataatctcatttttaactgcctgccggtgtgag

SEQ ID NO: 3480 - DNA, 48 bp, Artificial Sequence
  Synthetic polynucleotide
gtagcaacggctgtcaataagtctctcggcgtactccatgtgtggaga

SEQ ID NO: 3481 - DNA, 32 bp, Artificial Sequence
  Synthetic polynucleotide
ctgaaggaatctcagcctggttttcgattgct

SEQ ID NO: 3482 - DNA, 32 bp, Artificial Sequence
  Synthetic polynucleotide
aagttgaaccccgctcagtagtttcaaatatc

SEQ ID NO: 3483 - DNA, 48 bp, Artificial Sequence
  Synthetic polynucleotide
aactgtacttagcaacgttcaacatcccccgatttcataattgtcggg

SEQ ID NO: 3484 - DNA, 48 bp, Artificial Sequence
  Synthetic polynucleotide
tataacccggagagcagggactgcattccatgtaggaaaactaccgat

SEQ ID NO: 3485 - DNA, 48 bp, Artificial Sequence
  Synthetic polynucleotide
ccacattttcatgcattcttgcagtctccacagtcaggagtcacctaa

SEQ ID NO: 3486 - DNA, 48 bp, Artificial Sequence
  Synthetic polynucleotide
ggcaggcagttaaaaagttgctacagcgcccagttgaccttacagaat

SEQ ID NO: 3487 - DNA, 32 bp, Artificial Sequence; identical to SEQ ID NO: 1923
  Synthetic polynucleotide

SEQ ID NO: 3488 - DNA, 32 bp, Artificial Sequence
  Synthetic polynucleotide
tgttatatgatatttggggttatacaccgtgt

SEQ ID NO: 3489 - DNA, 48 bp, Artificial Sequence
  Synthetic polynucleotide
caccagcaggatgtcgggccttgacatgacattctcccacccgtccaa

SEQ ID NO: 3490 - DNA, 48 bp, Artificial Sequence
  Synthetic polynucleotide
atggtacacccagcattccttcagtccgcctatgattggtttagtgta

SEQ ID NO: 3491 - DNA, 48 bp, Artificial Sequence
  Synthetic polynucleotide
ttacgaaaagcaatcgaaaaccagcccgacaactcaatcatgctctcc

SEQ ID NO: 3492 - DNA, 48 bp, Artificial Sequence
  Synthetic polynucleotide
ttttcctacatggaatgtacagttcctgacatggcacttgaacttcgc

SEQ ID NO: 3493 - DNA, 32 bp, Artificial Sequence
  Synthetic polynucleotide
gaggcagcctcacaccagtgtggttggttcaa

SEQ ID NO: 3494 - DNA, 32 bp, Artificial Sequence
  Synthetic polynucleotide
aaccatttacacggtgtgtaccattatcaaag

SEQ ID NO: 3495 - DNA, 48 bp, Artificial Sequence
  Synthetic polynucleotide
gaacttgatactcgatcactgagtgccccctagcgcccactcgggaca

SEQ ID NO: 3496 - DNA, 48 bp, Artificial Sequence
  Synthetic polynucleotide
tgggagaactgtttaaggtcagaactgctctaagctgttctccccgtc

SEQ ID NO: 3497 - DNA, 48 bp, Artificial Sequence
  Synthetic polynucleotide
tgtactacctgtttacaattctcattggacggagtgttttatgctggg

SEQ ID NO: 3498 - DNA, 48 bp, Artificial Sequence
  Synthetic polynucleotide
accaatcataggcggatgctggtgtgtcaagttgtgggctcatcgccg

SEQ ID NO: 3499 - DNA, 32 bp, Artificial Sequence
  Synthetic polynucleotide
ctcatgatctttgatattctcccaaatggata

SEQ ID NO: 3500 - DNA, 32 bp, Artificial Sequence
  Synthetic polynucleotide
cacagtcaatcggtaggtgggccttgaggtta

SEQ ID NO: 3501 - DNA, 48 bp, Artificial Sequence
  Synthetic polynucleotide
gaacagcttagagcagtcaagttcggatacgcttcatgtcgccttttc

SEQ ID NO: 3502 - DNA, 48 bp, Artificial Sequence; identical to SEQ ID NO: 3064
  Synthetic polynucleotide

SEQ ID NO: 3503 - DNA, 48 bp, Artificial Sequence
  Synthetic polynucleotide
agcttcgcaatcttctgctgcctctaggggggcgtgggtcttagagtt

SEQ ID NO: 3504 - DNA, 48 bp, Artificial Sequence
  Synthetic polynucleotide
actcctgaattctgtaaggtcaactgggcgctaaatgtggccctttgc

SEQ ID NO: 3505 - DNA, 32 bp, Artificial Sequence
  Synthetic polynucleotide
taggcaagtacactaacattacgaacaccgat

SEQ ID NO: 3506 - DNA, 32 bp, Artificial Sequence
  Synthetic polynucleotide
tcaaggaatatccattgcgaagcttacaggca

SEQ ID NO: 3507 - DNA, 48 bp, Artificial Sequence
  Synthetic polynucleotide
cggacgaagcgaagttcaagtgccatgtcaggtttcgtaaatattgaa

SEQ ID NO: 3508 - DNA, 48 bp, Artificial Sequence
  Synthetic polynucleotide
gactattgcaatatactgactgtgatcgcggacaaggacatccactgc

SEQ ID NO: 3509 - DNA, 48 bp, Artificial Sequence
  Synthetic polynucleotide
cggccagctaacctcaaggcccacgcaaagggatataacaagaagatt

SEQ ID NO: 3510 - DNA, 48 bp, Artificial Sequence
  Synthetic polynucleotide
gacccacgcccccctatcaggagtcgtttctttaaccaggaaacggcc

SEQ ID NO: 3511 - DNA, 32 bp, Artificial Sequence; identical to SEQ ID NO: 45
  Synthetic polynucleotide

SEQ ID NO: 3512 - DNA, 32 bp, Artificial Sequence; identical to SEQ ID NO: 3215
  Synthetic polynucleotide

SEQ ID NO: 3513 - DNA, 48 bp, Artificial Sequence
  Synthetic polynucleotide
tttcatggcggcgatgagcccacaacttgacagtagtacagtatcttt

SEQ ID NO: 3514 - DNA, 48 bp, Artificial Sequence
  Synthetic polynucleotide
gggcgtaaacaaaaaacttgcctatcgtgccctagcgagtaagagata

SEQ ID NO: 3515 - DNA, 48 bp, Artificial Sequence
  Synthetic polynucleotide
gagtgtgtatcggtgttcgtaatgttcaatataaatggttgtatattg

SEQ ID NO: 3516 - DNA, 48 bp, Artificial Sequence
  Synthetic polynucleotide
tgtccttgtccgcgatttcgtccggtgctctagacatattcaaatgag

SEQ ID NO: 3517 - DNA, 32 bp, Artificial Sequence
  Synthetic polynucleotide
gtcggcccaactctaagactctacagataggt

SEQ ID NO: 3518 - DNA, 32 bp, Artificial Sequence
  Synthetic polynucleotide
acaactgttcggtcacttacgcccagacaatg

SEQ ID NO: 3519 - DNA, 48 bp, Artificial Sequence
  Synthetic polynucleotide
tgacgatcgaaaaggcgacatgaagcgtatccaccttcaatcgtctac

SEQ ID NO: 3520 - DNA, 48 bp, Artificial Sequence
  Synthetic polynucleotide
taggtggtcctgggaacataggtattcataactcatccggttacttcg

SEQ ID NO: 3521 - DNA, 48 bp, Artificial Sequence
  Synthetic polynucleotide
cgtacgcaatcatggtgtcgcataaaagatacatcatgagttttttgt

SEQ ID NO: 3522 - DNA, 48 bp, Artificial Sequence
  Synthetic polynucleotide
actcgctagggcacgaccatgaaacgcgagcaaacggcgagtccggtc

SEQ ID NO: 3523 - DNA, 32 bp, Artificial Sequence
  Synthetic polynucleotide
tcatacagcattgtctaccacctatgttctta

SEQ ID NO: 3524 - DNA, 32 bp, Artificial Sequence
  Synthetic polynucleotide
catttggggcagtggatgcttgctccttgctc

SEQ ID NO: 3525 - DNA, 48 bp, Artificial Sequence
  Synthetic polynucleotide
ccggatgagttatgaagatcgtcattgggatagaacggtgacacactt

SEQ ID NO: 3526 - DNA, 48 bp, Artificial Sequence; identical to SEQ ID NO: 3076
  Synthetic polynucleotide

SEQ ID NO: 3527 - DNA, 48 bp, Artificial Sequence
  Synthetic polynucleotide
gcgctagtcacgcgaagggccgacaatcggcggactgcctcattaata

SEQ ID NO: 3528 - DNA, 48 bp, Artificial Sequence
  Synthetic polynucleotide
ggaccatcggccgtttcctggttaaagaaacggctggccgccctcatg

SEQ ID NO: 3529 - DNA, 32 bp, Artificial Sequence
  Synthetic polynucleotide
gcccgacgtatctcttcgtaccccccctggag

SEQ ID NO: 3530 - DNA, 32 bp, Artificial Sequence
  Synthetic polynucleotide
ttgtgaactaagaacaactagcgcttccagta

SEQ ID NO: 3531 - DNA, 48 bp, Artificial Sequence
  Synthetic polynucleotide
gatgaaggctcatttgaatatgtctagagcacacacactcgggctcac

SEQ ID NO: 3532 - DNA, 48 bp, Artificial Sequence
  Synthetic polynucleotide
gcttaacatcatttgccccaaatgcgccagggtaggtatgtgcatatt

SEQ ID NO: 3533 - DNA, 48 bp, Artificial Sequence
  Synthetic polynucleotide
ctggactagagcaaggagcaagcacatgagggtggacaaattcgcgtg

SEQ ID NO: 3534 - DNA, 48 bp, Artificial Sequence
  Synthetic polynucleotide
aggcagtccgccgattgatggtccgagccagaacctgttggatgctga

SEQ ID NO: 3535 - DNA, 32 bp, Artificial Sequence; identical to SEQ ID NO: 47
  Synthetic polynucleotide

SEQ ID NO: 3536 - DNA, 32 bp, Artificial Sequence
  Synthetic polynucleotide
cacctgtatactggaatgttaagcgtaaataa

SEQ ID NO: 3537 - DNA, 48 bp, Artificial Sequence
  Synthetic polynucleotide
atagcgtagaccggactcgccgtttgctcgcgtgcgtacggcttttat

SEQ ID NO: 3538 - DNA, 48 bp, Artificial Sequence
  Synthetic polynucleotide
tgctgttaacatagatcgtcgggcgaccttcgtgtgggaggatcatta

SEQ ID NO: 3539 - DNA, 48 bp, Artificial Sequence
  Synthetic polynucleotide
tccccagcctccagggggggtacggtgagcccacagttgtgcaaatga

SEQ ID NO: 3540 - DNA, 48 bp, Artificial Sequence
  Synthetic polynucleotide
catacctaccctggcgccttcatcacggacttcagcgagcgttttacg

SEQ ID NO: 3541 - DNA, 32 bp, Artificial Sequence
  Synthetic polynucleotide
aagccacttattaatgtcgcacgacactccca

SEQ ID NO: 3542 - DNA, 32 bp, Artificial Sequence
  Synthetic polynucleotide
tccaataattatttactaacagcaggtcggcc

SEQ ID NO: 3543 - DNA, 48 bp, Artificial Sequence
  Synthetic polynucleotide
gtattactaagtgtgtcaccgttctatcccaactcaataagagtacat

SEQ ID NO: 3544 - DNA, 48 bp, Artificial Sequence
  Synthetic polynucleotide
tggtcggttagccagcagattgtagctgtgaccctatcttacgcttac

SEQ ID NO: 3545 - DNA, 48 bp, Artificial Sequence
  Synthetic polynucleotide
acgactctcgcagggtgctatgctataaaagcctgtatgaatctatgt

SEQ ID NO: 3546 - DNA, 48 bp, Artificial Sequence
  Synthetic polynucleotide
ctcccacacgaaggtctacgctattacgatttacggggttactctagc

SEQ ID NO: 3547 - DNA, 32 bp, Artificial Sequence
  Synthetic polynucleotide
taaggtggggccgaccaccgaccaaggcgcta

SEQ ID NO: 3548 - DNA, 32 bp, Artificial Sequence
  Synthetic polynucleotide
catcaagtaatatgcacgccccaactgctcct

SEQ ID NO: 3549 - DNA, 48 bp, Artificial Sequence
  Synthetic polynucleotide
aagatagggtcacagcagtaatacctctacctgtgttcattcagagta

SEQ ID NO: 3550 - DNA, 48 bp, Artificial Sequence; identical to SEQ ID NO: 3088
  Synthetic polynucleotide

SEQ ID NO: 3551 - DNA, 48 bp, Artificial Sequence
  Synthetic polynucleotide
cggcagttgtgaaaggagtggcttcctaggtgtccgcataaggattaa

SEQ ID NO: 3552 - DNA, 48 bp, Artificial Sequence
  Synthetic polynucleotide
tttattggtcagcatccaacaggttctggctctagtccaggatcgaac

SEQ ID NO: 3553 - DNA, 32 bp, Artificial Sequence
  Synthetic polynucleotide
gatatcgctaatgatcgacgaaggttccaggc

SEQ ID NO: 3554 - DNA, 32 bp, Artificial Sequence
  Synthetic polynucleotide
catcacggtagcgcctaactgccgaccagttt

SEQ ID NO: 3555 - DNA, 48 bp, Artificial Sequence
  Synthetic polynucleotide
cgattggtcgtaaaacgctcgctgaagtccgtgctggggaccctcaca

SEQ ID NO: 3556 - DNA, 48 bp, Artificial Sequence
  Synthetic polynucleotide
tataccaaccgacatcacttgatgccaagcatgcttaacttataccat

SEQ ID NO: 3557 - DNA, 48 bp, Artificial Sequence
  Synthetic polynucleotide
cagaggtcaggagcagttggggcggttcgatctacaggtgcctttcac

SEQ ID NO: 3558 - DNA, 48 bp, Artificial Sequence
  Synthetic polynucleotide
tatgcggacacctaggccaataaatcgcctctaaacagaacggacctc

SEQ ID NO: 3559 - DNA, 32 bp, Artificial Sequence; identical to SEQ ID NO: 49
  Synthetic polynucleotide

SEQ ID NO: 3560 - DNA, 32 bp, Artificial Sequence
  Synthetic polynucleotide
aacgtgggaaactggtttggtatatcctgata

SEQ ID NO: 3561 - DNA, 48 bp, Artificial Sequence
  Synthetic polynucleotide
ccggttctgctagagtaaccccgtaaatcgtaagagtcgttatgcccc

SEQ ID NO: 3562 - DNA, 48 bp, Artificial Sequence
  Synthetic polynucleotide
tagggtatactcgtaagcgatatctgaatgcgcaggatcaaagttgac

SEQ ID NO: 3563 - DNA, 48 bp, Artificial Sequence
  Synthetic polynucleotide
acttctttgcctggaaccttcgtctgtgagggttattggagatgtcgg

SEQ ID NO: 3564 - DNA, 48 bp, Artificial Sequence
  Synthetic polynucleotide
agttaagcatgcttggaccaatcgtacacaaagtgaacggtgggcatt

SEQ ID NO: 3565 - DNA, 32 bp, Artificial Sequence
  Synthetic polynucleotide
cagccttcttaatcctagcgtgatgcaggcgt

SEQ ID NO: 3566 - DNA, 32 bp, Artificial Sequence
  Synthetic polynucleotide
agtatgaatatcaggaataccctattgtcgtt

SEQ ID NO: 3567 - DNA, 48 bp, Artificial Sequence
  Synthetic polynucleotide
ggtacacgtactctgaatgaacacaggtagagctgtactatgctgtag

SEQ ID NO: 3568 - DNA, 48 bp, Artificial Sequence
  Synthetic polynucleotide
ggtattttcgaagtctgtccaacatgataatcctcgtgcttcgagaaa

SEQ ID NO: 3569 - DNA, 48 bp, Artificial Sequence
  Synthetic polynucleotide
tacttgaattctggtcgttatttcggggcataccaccttattacgagt

SEQ ID NO: 3570 - DNA, 48 bp, Artificial Sequence
  Synthetic polynucleotide
tgatcctgcgcattcaagaaccggcatctgatccagtcccttgtaatg

SEQ ID NO: 3571 - DNA, 32 bp, Artificial Sequence
  Synthetic polynucleotide
taatacgaaacgacaaaaaataccttcgccgg

SEQ ID NO: 3572 - DNA, 32 bp, Artificial Sequence
  Synthetic polynucleotide
taagaggcatggtatagcataatcttcgtgga

SEQ ID NO: 3573 - DNA, 48 bp, Artificial Sequence
  Synthetic polynucleotide
agcacgaggattatcacgtgtacctcgaaatagcggaaatatggccgc

SEQ ID NO: 3574 - DNA, 48 bp, Artificial Sequence; identical to SEQ ID NO: 3100
  Synthetic polynucleotide

SEQ ID NO: 3575 - DNA, 48 bp, Artificial Sequence
  Synthetic polynucleotide
cgcgagcaggggcgtcgaaggctgtctttgtgcagtgtcatcggtaca

SEQ ID NO: 3576 - DNA, 48 bp, Artificial Sequence
  Synthetic polynucleotide
tacgtatagaggtccgttctgtttagaggcgagacctctgtctgggtt

SEQ ID NO: 3577 - DNA, 32 bp, Artificial Sequence
  Synthetic polynucleotide
ggttcgtggtcaacttcatggtccggtcctct

SEQ ID NO: 3578 - DNA, 32 bp, Artificial Sequence
  Synthetic polynucleotide
cgatgcggccggcgaatgctcgcggggatttc

SEQ ID NO: 3579 - DNA, 48 bp, Artificial Sequence
  Synthetic polynucleotide
agtgacaaaatgcccaccgttcactttgtgtaaaagaagtactgcgag

SEQ ID NO: 3580 - DNA, 48 bp, Artificial Sequence
  Synthetic polynucleotide
tcggtgactagagaccgcctcttactgccttgcgactgggtccaaaag

SEQ ID NO: 3581 - DNA, 48 bp, Artificial Sequence
  Synthetic polynucleotide
ctgattggtccacgaagattatgcaacccagacccacgttgacgcccc

SEQ ID NO: 3582 - DNA, 48 bp, Artificial Sequence
  Synthetic polynucleotide
tgacactgcacaaagatatacgtagctgggaactttggttgcgctcga

SEQ ID NO: 3583 - DNA, 32 bp, Artificial Sequence; identical to SEQ ID NO: 51
  Synthetic polynucleotide

SEQ ID NO: 3584 - DNA, 32 bp, Artificial Sequence; identical to SEQ ID NO: 3224
  Synthetic polynucleotide

SEQ ID NO: 3585 - DNA, 48 bp, Artificial Sequence
  Synthetic polynucleotide
cctccccgcattacaagggactggatcagatgttcaagtattcggtga

SEQ ID NO: 3586 - DNA, 48 bp, Artificial Sequence
  Synthetic polynucleotide
tccgtccgttggagcccacgaaccaacgcatctagcagaataatttgc

SEQ ID NO: 3587 - DNA, 48 bp, Artificial Sequence
  Synthetic polynucleotide
aagccgtgagaggaccggaccatgctcgcagtttcatactggtctcta

SEQ ID NO: 3588 - DNA, 48 bp, Artificial Sequence
  Synthetic polynucleotide
cccagtcgcaaggcagttgtcactcatcggctgactacctacatcagg

SEQ ID NO: 3589 - DNA, 32 bp, Artificial Sequence
  Synthetic polynucleotide
catatccgtgtaccgaccacggaaggtatgct

SEQ ID NO: 3590 - DNA, 32 bp, Artificial Sequence
  Synthetic polynucleotide
ggccgaaaagaaaacccggacggaaaactaca

SEQ ID NO: 3591 - DNA, 48 bp, Artificial Sequence
  Synthetic polynucleotide
taggttaagcggccatatttccgctatttcgacgaacgcattgcgggg

SEQ ID NO: 3592 - DNA, 48 bp, Artificial Sequence
  Synthetic polynucleotide
gtaatggtcccctcagctaacgatgtgggaggctaccgctaggagaaa

SEQ ID NO: 3593 - DNA, 48 bp, Artificial Sequence
  Synthetic polynucleotide
tacatacggcctgtttcggaacagtcaccgaatcgtattaggctccaa

SEQ ID NO: 3594 - DNA, 48 bp, Artificial Sequence
  Synthetic polynucleotide
ttctgctagatgcgttcggggaggttacttggtaagcgcgcacccgtt

SEQ ID NO: 3595 - DNA, 32 bp, Artificial Sequence
  Synthetic polynucleotide
cttagtgctgtagtttaccattaccggaggcg

SEQ ID NO: 3596 - DNA, 32 bp, Artificial Sequence
  Synthetic polynucleotide
aacgatatcttttggagtccggtgtacgagat

SEQ ID NO: 3597 - DNA, 48 bp, Artificial Sequence
  Synthetic polynucleotide
agcggtagcctcccacttaacctatgccttggttcggtgcgcagcggg

SEQ ID NO: 3598 - DNA, 48 bp, Artificial Sequence; identical to SEQ ID NO: 3112
  Synthetic polynucleotide

SEQ ID NO: 3599 - DNA, 48 bp, Artificial Sequence
  Synthetic polynucleotide
tagactttgactcagacggatatgctgtagacgccagggttatccggt

SEQ ID NO: 3600 - DNA, 48 bp, Artificial Sequence
  Synthetic polynucleotide
acggaaattcgagcgcaaccaaagttcccagcccaatcaggtcatcat

SEQ ID NO: 3601 - DNA, 32 bp, Artificial Sequence
  Synthetic polynucleotide
cgtcccatgcaaattaaaacatacttgcggca

SEQ ID NO: 3602 - DNA, 32 bp, Artificial Sequence
  Synthetic polynucleotide
gatcaccccgcctccgaaagtctaagaaggga

SEQ ID NO: 3603 - DNA, 48 bp, Artificial Sequence
  Synthetic polynucleotide
gcccttatcctgatgtaggtagtcagccgatgcacggcttagtatcca

SEQ ID NO: 3604 - DNA, 48 bp, Artificial Sequence
  Synthetic polynucleotide
aatccgggcccgctgaatatcgttacagagattcttcagggcagtttt

SEQ ID NO: 3605 - DNA, 48 bp, Artificial Sequence
  Synthetic polynucleotide
ggctatagatctcgtacaccggacatgatgacaatacccatctgagtc

SEQ ID NO: 3606 - DNA, 48 bp, Artificial Sequence
  Synthetic polynucleotide
accctggcgtctacagatttccgtcgtccaccatttgggcattgactt

SEQ ID NO: 3607 - DNA, 32 bp, Artificial Sequence
  Synthetic polynucleotide
taactgattttctcctggttccgctagctgat

SEQ ID NO: 3608 - DNA, 32 bp, Artificial Sequence
  Synthetic polynucleotide
ggtcggcgtcccttctcccggatttcaggtcg

SEQ ID NO: 3609 - DNA, 48 bp, Artificial Sequence
  Synthetic polynucleotide
tgcgagtgaacgggtgcgcgcttaccaagtaacgtatgtacgacgcga

SEQ ID NO: 3610 - DNA, 48 bp, Artificial Sequence
  Synthetic polynucleotide
cattaggtctattataatgggacgccactacgatccgaataaggtacg

SEQ ID NO: 3611 - DNA, 48 bp, Artificial Sequence
  Synthetic polynucleotide
tcactctttgccgcaagtatgttttggatacttttcggcctcagcggg

SEQ ID NO: 3612 - DNA, 48 bp, Artificial Sequence
  Synthetic polynucleotide
cctgaagaatctctgtataagggcgattcttctttgcgtgcctaacca

SEQ ID NO: 3613 - DNA, 32 bp, Artificial Sequence
  Synthetic polynucleotide
aaggaacgaccggatattgtgctgcacagcac

SEQ ID NO: 3614 - DNA, 32 bp, Artificial Sequence
  Synthetic polynucleotide
aagtgtgacgacctgaacctaatgattttata

SEQ ID NO: 3615 - DNA, 48 bp, Artificial Sequence
  Synthetic polynucleotide
cgagggttcccgctgcgcaccgaaccaaggcaatcccctcgcgagggt

SEQ ID NO: 3616 - DNA, 48 bp, Artificial Sequence
  Synthetic polynucleotide
acagtgcctaacggccatcagttaatattaaggaccatagtgtttcac

SEQ ID NO: 3617 - DNA, 48 bp, Artificial Sequence
  Synthetic polynucleotide
gcctggccatcagctagcggaacctcgcgtcggcactaagtataatag

SEQ ID NO: 3618 - DNA, 48 bp, Artificial Sequence
  Synthetic polynucleotide
attcggatcgtagtggcactcgcaccgaacgaaattcatcgtcctcac

SEQ ID NO: 3619 - DNA, 32 bp, Artificial Sequence
  Synthetic polynucleotide
tatcgttctataaaatggcactgtcacggcgc

SEQ ID NO: 3620 - DNA, 32 bp, Artificial Sequence
  Synthetic polynucleotide
cgcgaatcaaaactgcgcctgatacaggtctc

SEQ ID NO: 3621 - DNA, 48 bp, Artificial Sequence
  Synthetic polynucleotide
ctatggtccttaatataaccctcggaggcaagccgcctgtaacgctta

SEQ ID NO: 3622 - DNA, 48 bp, Artificial Sequence; identical to SEQ ID NO: 3124
  Synthetic polynucleotide

SEQ ID NO: 3623 - DNA, 48 bp, Artificial Sequence
  Synthetic polynucleotide
gcacgatatgatatgtcgttccttaaggccaacgacatcgaccgttca

SEQ ID NO: 3624 - DNA, 48 bp, Artificial Sequence
  Synthetic polynucleotide
agcctcgtaagtcaatgcccaaatggtggacgctatagccgtggcgtt

SEQ ID NO: 3625 - DNA, 32 bp, Artificial Sequence
  Synthetic polynucleotide
aggtcatccgtacctttgaaagaaacgggtac

SEQ ID NO: 3626 - DNA, 32 bp, Artificial Sequence
  Synthetic polynucleotide
ttgttgcggcgccgtgtatcgtgccggcatta

SEQ ID NO: 3627 - DNA, 48 bp, Artificial Sequence
  Synthetic polynucleotide
ggcgtttgtggttaggcacgcaaagaagaatcaagagtgagcccccgt

SEQ ID NO: 3628 - DNA, 48 bp, Artificial Sequence
  Synthetic polynucleotide
aggttgttgagacctgtatcaggcaacgccaccgccgaccacatatca

SEQ ID NO: 3629 - DNA, 32 bp, Artificial Sequence; identical to SEQ ID NO: 56
  Synthetic polynucleotide

SEQ ID NO: 3630 - DNA, 32 bp, Artificial Sequence
  Synthetic polynucleotide
acgcgttttaatgccgacatggaacgttatag

SEQ ID NO: 3631 - DNA, 48 bp, Artificial Sequence
  Synthetic polynucleotide
tctggcgcgtgaggacgatgaatttcgttcggggccaggcgatctaag

SEQ ID NO: 3632 - DNA, 48 bp, Artificial Sequence
  Synthetic polynucleotide
aaataaaggtacccgtttctttcaacgggggctcacacttcctacatg

SEQ ID NO: 3633 - DNA, 48 bp, Artificial Sequence
  Synthetic polynucleotide
tatcattggccagagatgctaactgtatgacggaccaggttttttttt

SEQ ID NO: 3634 - DNA, 48 bp, Artificial Sequence
  Synthetic polynucleotide
tgcatgggtggtggatcgcgaagctgtcgtgaatgatcggtttttttt

SEQ ID NO: 3635 - DNA, 32 bp, Artificial Sequence
  Synthetic polynucleotide
acaatggtatcttttgaagcgcacgtaaaccg

SEQ ID NO: 3636 - DNA, 32 bp, Artificial Sequence
  Synthetic polynucleotide
ccgcaacctttacgtgtttagggaatacaaga

SEQ ID NO: 3637 - DNA, 32 bp, Artificial Sequence; identical to SEQ ID NO: 1352
  Synthetic polynucleotide

SEQ ID NO: 3638 - DNA, 32 bp, Artificial Sequence
  Synthetic polynucleotide
ccgatcattcacgacaaatctcccgctagatg

SEQ ID NO: 3639 - DNA, 32 bp, Artificial Sequence
  Synthetic polynucleotide
ttttttttcggtttaccgagatgttttttttt

SEQ ID NO: 3640 - DNA, 32 bp, Artificial Sequence
  Synthetic polynucleotide
tttttttttcttgtataaagactgtttttttt

SEQ ID NO: 3641 - DNA, 32 bp, Artificial Sequence
  Synthetic polynucleotide
tttttttttatctttcggttgcggtttttttt

SEQ ID NO: 3642 - DNA, 32 bp, Artificial Sequence
  Synthetic polynucleotide
ttttttttatccgtcaaccattgttttttttt

SEQ ID NO: 3643 - DNA, 32 bp, Artificial Sequence
  Synthetic polynucleotide
ttttttttttacttctagtgtaagtttttttt

SEQ ID NO: 3644 - DNA, 32 bp, Artificial Sequence
  Synthetic polynucleotide
ttttttttcatctagcattacctttttttttt

SEQ ID NO: 3645 - DNA, 48 bp, Artificial Sequence
  Synthetic polynucleotide
ttttttttgagccacttaacctggtgcgatcaatcccggacacgtaaa

SEQ ID NO: 3646 - DNA, 48 bp, Artificial Sequence
  Synthetic polynucleotide
ttttttttcaaccaaaagatgttccccactgtttatattacaaaagat

SEQ ID NO: 3647 - DNA, 48 bp, Artificial Sequence
  Synthetic polynucleotide
gaacataattgctatatcggactgtgggcgtacctacacctttttttt

SEQ ID NO: 3648 - DNA, 48 bp, Artificial Sequence
  Synthetic polynucleotide
acggacttgaagcgaggaagttttgcgactcattgctgagtttttttt

SEQ ID NO: 3649 - DNA, 32 bp, Artificial Sequence
  Synthetic polynucleotide
atataggtctgacacccagctcccaggtaagt

SEQ ID NO: 3650 - DNA, 32 bp, Artificial Sequence
  Synthetic polynucleotide
agcaatatcacggacaggaacaacgggtgtca

SEQ ID NO: 3651 - DNA, 32 bp, Artificial Sequence
  Synthetic polynucleotide
ggtgtaggtacgcccataaactacttttccac

SEQ ID NO: 3652 - DNA, 32 bp, Artificial Sequence
  Synthetic polynucleotide
ctcagcaatgagtcgcttgagtcggtggataa

SEQ ID NO: 3653 - DNA, 32 bp, Artificial Sequence
  Synthetic polynucleotide
ttttttttacttacctccacatgatttttttt

SEQ ID NO: 3654 - DNA, 32 bp, Artificial Sequence
  Synthetic polynucleotide
tttttttttgacacccgagtcggctttttttt

SEQ ID NO: 3655 - DNA, 32 bp, Artificial Sequence
  Synthetic polynucleotide
ttttttttctaccgacatattgcttttttttt

SEQ ID NO: 3656 - DNA, 32 bp, Artificial Sequence
  Synthetic polynucleotide
ttttttttgcaggttaacctatattttttttt

SEQ ID NO: 3657 - DNA, 32 bp, Artificial Sequence
  Synthetic polynucleotide
ttttttttgtggaaaattgtgatctttttttt

SEQ ID NO: 3658 - DNA, 32 bp, Artificial Sequence
  Synthetic polynucleotide
ttttttttttatccacgcctcagttttttttt

SEQ ID NO: 3659 - DNA, 48 bp, Artificial Sequence
  Synthetic polynucleotide
ttttttttaaccgtgagtatgattagttttggctgctgaatgtccgtg

SEQ ID NO: 3660 - DNA, 48 bp, Artificial Sequence
  Synthetic polynucleotide
ttttttttatagccagataatagttctcataacaggcaagggtgtcag

SEQ ID NO: 3661 - DNA, 48 bp, Artificial Sequence
  Synthetic polynucleotide
ctcgaattgtgtttccatgctagcgccacacgactacttatttttttt

SEQ ID NO: 3662 - DNA, 48 bp, Artificial Sequence
  Synthetic polynucleotide
ttacctataggcggaaaaattgacatttctacaatcgtgatttttttt

SEQ ID NO: 3663 - DNA, 32 bp, Artificial Sequence; identical to SEQ ID NO: 1016
  Synthetic polynucleotide

SEQ ID NO: 3664 - DNA, 32 bp, Artificial Sequence
  Synthetic polynucleotide
ccgtcacgcattgtggttcgccgcgtcgtttt

SEQ ID NO: 3665 - DNA, 32 bp, Artificial Sequence
  Synthetic polynucleotide
taagtagtcgtgtggctgcaagccctcacctg

SEQ ID NO: 3666 - DNA, 32 bp, Artificial Sequence
  Synthetic polynucleotide
tcacgattgtagaaattttacaaagacggaca

SEQ ID NO: 3667 - DNA, 32 bp, Artificial Sequence
  Synthetic polynucleotide
ttttttttcacaggattcttgctttttttttt

SEQ ID NO: 3668 - DNA, 32 bp, Artificial Sequence
  Synthetic polynucleotide
ttttttttaaaacgacgcgggccgtttttttt

SEQ ID NO: 3669 - DNA, 32 bp, Artificial Sequence
  Synthetic polynucleotide
ttttttttaaacccagcgtgacggtttttttt

SEQ ID NO: 3670 - DNA, 32 bp, Artificial Sequence
  Synthetic polynucleotide
ttttttttgggacatgggtagaagtttttttt

SEQ ID NO: 3671 - DNA, 32 bp, Artificial Sequence
  Synthetic polynucleotide
ttttttttcaggtgagcgggcccatttttttt

SEQ ID NO: 3672 - DNA, 32 bp, Artificial Sequence
  Synthetic polynucleotide
tttttttttgtccgtcaatgagcttttttttt

SEQ ID NO: 3673 - DNA, 48 bp, Artificial Sequence
  Synthetic polynucleotide
ttttttttccatccctaagtaaacaggatatggcgccagaccacaatg

SEQ ID NO: 3674 - DNA, 48 bp, Artificial Sequence
  Synthetic polynucleotide
ttttttttgaagcgtaatcgactaatgccagcattactggcattaaga

SEQ ID NO: 3675 - DNA, 48 bp, Artificial Sequence
  Synthetic polynucleotide
tgtaccgcattcatggagatcatccattgacgtcgttacgtttttttt

SEQ ID NO: 3676 - DNA, 48 bp, Artificial Sequence
  Synthetic polynucleotide
cctaatgaggagtatggttaggaatacctgctcctgaatgtttttttt

SEQ ID NO: 3677 - DNA, 32 bp, Artificial Sequence; identical to SEQ ID NO: 2032
  Synthetic polynucleotide

SEQ ID NO: 3678 - DNA, 32 bp, Artificial Sequence; identical to SEQ ID NO: 2084
  Synthetic polynucleotide

SEQ ID NO: 3679 - DNA, 32 bp, Artificial Sequence
  Synthetic polynucleotide
cgtaacgacgtcaatgttaaaacaacaaccga

SEQ ID NO: 3680 - DNA, 32 bp, Artificial Sequence
  Synthetic polynucleotide
cattcaggagcaggtacagaaaaggaaccgac

SEQ ID NO: 3681 - DNA, 32 bp, Artificial Sequence
  Synthetic polynucleotide
ttttttttcgatagtaggtaggtttttttttt

SEQ ID NO: 3682 - DNA, 32 bp, Artificial Sequence
  Synthetic polynucleotide
ttttttttagggctgccccccaagtttttttt

SEQ ID NO: 3683 - DNA, 32 bp, Artificial Sequence
  Synthetic polynucleotide
ttttttttcggtggacagaactcttttttttt

SEQ ID NO: 3684 - DNA, 32 bp, Artificial Sequence
  Synthetic polynucleotide
tttttttttcttggtgcgtaggagtttttttt

SEQ ID NO: 3685 - DNA, 32 bp, Artificial Sequence
  Synthetic polynucleotide
tttttttttcggttgtcgctgtaatttttttt

SEQ ID NO: 3686 - DNA, 32 bp, Artificial Sequence
  Synthetic polynucleotide
ttttttttgtcggttcgataggactttttttt

SEQ ID NO: 3687 - DNA, 48 bp, Artificial Sequence
  Synthetic polynucleotide
tttttttttccggtttagcgaattctaatcacggcggatatggctggt

SEQ ID NO: 3688 - DNA, 48 bp, Artificial Sequence
  Synthetic polynucleotide
ttttttttgaaggagtttagtgagtctgcaacatagaatgctattgag

SEQ ID NO: 3689 - DNA, 48 bp, Artificial Sequence
  Synthetic polynucleotide
ttccatgtcatgtagggattcgcgattgatccacctcgcctttttttt

SEQ ID NO: 3690 - DNA, 48 bp, Artificial Sequence
  Synthetic polynucleotide
cgatgtcgttggccttacgaggctgctagggctgtatggttttttttt

SEQ ID NO: 3691 - DNA, 32 bp, Artificial Sequence
  Synthetic polynucleotide
ctttcagtgtgagtgtgatgacctcgcagcct

SEQ ID NO: 3692 - DNA, 32 bp, Artificial Sequence; identical to SEQ ID NO: 2095
  Synthetic polynucleotide

SEQ ID NO: 3693 - DNA, 32 bp, Artificial Sequence; identical to SEQ ID NO: 3225
  Synthetic polynucleotide

SEQ ID NO: 3694 - DNA, 32 bp, Artificial Sequence
  Synthetic polynucleotide
accatacagccctagcaacaacctcagcaata

SEQ ID NO: 3695 - DNA, 32 bp, Artificial Sequence
  Synthetic polynucleotide
ttttttttaggctgcggcgccagatttttttt

SEQ ID NO: 3696 - DNA, 32 bp, Artificial Sequence
  Synthetic polynucleotide
tttttttttttgcattcctctccctttttttt

SEQ ID NO: 3697 - DNA, 32 bp, Artificial Sequence
  Synthetic polynucleotide
tttttttttgaacggtcgatagaatttttttt

SEQ ID NO: 3698 - DNA, 32 bp, Artificial Sequence
  Synthetic polynucleotide
ttttttttctataacgactgaaagtttttttt

SEQ ID NO: 3699 - DNA, 32 bp, Artificial Sequence
  Synthetic polynucleotide
ttttttttcaacgctcctttattttttttttt

SEQ ID NO: 3700 - DNA, 32 bp, Artificial Sequence
  Synthetic polynucleotide
tttttttttattgctgaaacgcgttttttttt

SEQ ID NO: 3701 - DNA, 48 bp, Artificial Sequence
  Synthetic polynucleotide
tttttttttaagcgttacaggcggcttgcctcattacgacaaggagat

SEQ ID NO: 3702 - DNA, 48 bp, Artificial Sequence
  Synthetic polynucleotide
ttttttttcccgagccaggtggcccttagatcgaacgataacactcac

SEQ ID NO: 3703 - DNA, 16 bp, Artificial Sequence
  Synthetic polynucleotide
gtattagctttttttt

SEQ ID NO: 3704 - DNA, 16 bp, Artificial Sequence
  Synthetic polynucleotide
gtattacttttttttt

SEQ ID NO: 3705 - DNA, 16 bp, Artificial Sequence
  Synthetic polynucleotide
atgtggtttttttttt

SEQ ID NO: 3706 - DNA, 16 bp, Artificial Sequence
  Synthetic polynucleotide
ttttttttgccttatg

SEQ ID NO: 3707 - DNA, 16 bp, Artificial Sequence
  Synthetic polynucleotide
ttttttttgaggagca

SEQ ID NO: 3708 - DNA, 16 bp, Artificial Sequence
  Synthetic polynucleotide
ttttttttaattcttc

SEQ ID NO: 3709 - DNA, 32 bp, Artificial Sequence
  Synthetic polynucleotide
gcgacgctttttttttttttttttggtcggcc

SEQ ID NO: 3710 - DNA, 32 bp, Artificial Sequence
  Synthetic polynucleotide
tcggcagcttttttttttttttttgtacaaat

SEQ ID NO: 3711 - DNA, 32 bp, Artificial Sequence
  Synthetic polynucleotide
atggattgttttttttttttttttctacttca

SEQ ID NO: 3712 - DNA, 32 bp, Artificial Sequence
  Synthetic polynucleotide
acattggtttttttttttttttttcgagtgga

SEQ ID NO: 3713 - DNA, 32 bp, Artificial Sequence
  Synthetic polynucleotide
aagccactttttttttttttttttacaatttc

SEQ ID NO: 3714 - DNA, 32 bp, Artificial Sequence
  Synthetic polynucleotide
tcgctttattttttttttttttttgcctacct

SEQ ID NO: 3715 - DNA, 32 bp, Artificial Sequence
  Synthetic polynucleotide
catattttttttttttttttttttgggtggtc

SEQ ID NO: 3716 - DNA, 32 bp, Artificial Sequence
  Synthetic polynucleotide
ttggggcgttttttttttttttttcaccaggt

SEQ ID NO: 3717 - DNA, 32 bp, Artificial Sequence
  Synthetic polynucleotide
ccgtcctattttttttttttttttcctttcac

SEQ ID NO: 3718 - DNA, 48 bp, Artificial Sequence
  Synthetic polynucleotide
tgttttcgttttttttttttttttaaaagcccgggctgatcccgcaac

SEQ ID NO: 3719 - DNA, 48 bp, Artificial Sequence
  Synthetic polynucleotide
aaagcttcttttttttttttttttgctgtgaccctatcttacgcttac

SEQ ID NO: 3720 - DNA, 48 bp, Artificial Sequence
  Synthetic polynucleotide
ccatgaaattttttttttttttttacaccggccgtcttaatgactacc

SEQ ID NO: 3721 - DNA, 16 bp, Artificial Sequence
  Synthetic polynucleotide
tttcatggcggcgatg

SEQ ID NO: 3722 - DNA, 16 bp, Artificial Sequence
  Synthetic polynucleotide
taaggtggggccgacc

SEQ ID NO: 3723 - DNA, 16 bp, Artificial Sequence
  Synthetic polynucleotide
accaatgtaagcagat

SEQ ID NO: 3724 - DNA, 16 bp, Artificial Sequence
  Synthetic polynucleotide
cccaggaagaccaccc

SEQ ID NO: 3725 - DNA, 16 bp, Artificial Sequence
  Synthetic polynucleotide
gctggccgccctcatg

SEQ ID NO: 3726 - DNA, 16 bp, Artificial Sequence
  Synthetic polynucleotide
tttcaaaagaagaatt

SEQ ID NO: 3727 - DNA, 32 bp, Artificial Sequence; identical to SEQ ID NO: 48
  Synthetic polynucleotide

SEQ ID NO: 3728 - DNA, 32 bp, Artificial Sequence; identical to SEQ ID NO: 432
  Synthetic polynucleotide

SEQ ID NO: 3729 - DNA, 32 bp, Artificial Sequence; identical to SEQ ID NO: 2012
  Synthetic polynucleotide

SEQ ID NO: 3730 - DNA, 32 bp, Artificial Sequence; identical to SEQ ID NO: 2096
  Synthetic polynucleotide

SEQ ID NO: 3731 - DNA, 32 bp, Artificial Sequence
  Synthetic polynucleotide
cggcagttgtgaaaggagtggcttcctaggtg

SEQ ID NO: 3732 - DNA, 32 bp, Artificial Sequence
  Synthetic polynucleotide
aaccgataacctggtgtaaagcgagtaacgac

SEQ ID NO: 3733 - DNA, 32 bp, Artificial Sequence; identical to SEQ ID NO: 3548
  Synthetic polynucleotide

SEQ ID NO: 3734 - DNA, 32 bp, Artificial Sequence
  Synthetic polynucleotide
cagtggcccataaggcattgttgtagcgatta

SEQ ID NO: 3735 - DNA, 32 bp, Artificial Sequence
  Synthetic polynucleotide
aagcggtctgctcctcctacttttgacgtcag

SEQ ID NO: 3736 - DNA, 48 bp, Artificial Sequence
  Synthetic polynucleotide
atcagcccgggcttttgctaatacgctgagcgccaggttaagtggctc

SEQ ID NO: 3737 - DNA, 48 bp, Artificial Sequence
  Synthetic polynucleotide
atgcggagaggtaggcagcgtcgcttaaagtgtacggcaccgaggcct

SEQ ID NO: 3738 - DNA, 48 bp, Artificial Sequence
  Synthetic polynucleotide
tgatcagccctgctaaaaaatatgcagggttaagagtctggagatgat

SEQ ID NO: 3739 - DNA, 32 bp, Artificial Sequence
  Synthetic polynucleotide
agcaggtccatcgccgacattacgtacactcg

SEQ ID NO: 3740 - DNA, 32 bp, Artificial Sequence
  Synthetic polynucleotide
tggctcgtggctagaaaacatggtatcgctga

SEQ ID NO: 3741 - DNA, 32 bp, Artificial Sequence
  Synthetic polynucleotide
ataccctatatgccctctccgcatcatgttgt

SEQ ID NO: 3742 - DNA, 32 bp, Artificial Sequence
  Synthetic polynucleotide
gtgccgtacactttaattcctgggcgtgctag

SEQ ID NO: 3743 - DNA, 32 bp, Artificial Sequence
  Synthetic polynucleotide
actgtagtgcctcgtgtatcggtttttcatag

SEQ ID NO: 3744 - DNA, 32 bp, Artificial Sequence
  Synthetic polynucleotide
tagatgcgtgtccgtaaactgccgaccagttt

SEQ ID NO: 3745 - DNA, 32 bp, Artificial Sequence
  Synthetic polynucleotide
tataccaaatctgcttttgtcaagactagctc

SEQ ID NO: 3746 - DNA, 32 bp, Artificial Sequence
  Synthetic polynucleotide
agtgcgcccacctaggacttgatgccaagcat

SEQ ID NO: 3747 - DNA, 32 bp, Artificial Sequence
  Synthetic polynucleotide
cgaaactcgtcgttacgctgatcaagatgtag

SEQ ID NO: 3748 - DNA, 48 bp, Artificial Sequence
  Synthetic polynucleotide
tgaggtcgcatgagggcggccagctttttttttttttttttttcactg

SEQ ID NO: 3749 - DNA, 48 bp, Artificial Sequence
  Synthetic polynucleotide
tggccctttaatcgctacaacaattttttttttttttttttgcatatt

SEQ ID NO: 3750 - DNA, 48 bp, Artificial Sequence
  Synthetic polynucleotide
agtatggcctgacgtcaaaagtagttttttttttttttttttagcagg

SEQ ID NO: 3751 - DNA, 32 bp, Artificial Sequence; identical to SEQ ID NO: 11
  Synthetic polynucleotide

SEQ ID NO: 3752 - DNA, 32 bp, Artificial Sequence; identical to SEQ ID NO: 49
  Synthetic polynucleotide

SEQ ID NO: 3753 - DNA, 32 bp, Artificial Sequence; identical to SEQ ID NO: 2013
  Synthetic polynucleotide

SEQ ID NO: 3754 - DNA, 32 bp, Artificial Sequence; identical to SEQ ID NO: 2068
  Synthetic polynucleotide

SEQ ID NO: 3755 - DNA, 32 bp, Artificial Sequence; identical to SEQ ID NO: 2097
  Synthetic polynucleotide

SEQ ID NO: 3756 - DNA, 32 bp, Artificial Sequence
  Synthetic polynucleotide
gaccaactctatgaaaggcgcacttaattctg

SEQ ID NO: 3757 - DNA, 32 bp, Artificial Sequence
  Synthetic polynucleotide
tgaccctactacatctccttcgcgcccgacaa

SEQ ID NO: 3758 - DNA, 32 bp, Artificial Sequence
  Synthetic polynucleotide
agttaagcatgcttggaccaatcgtacacaaa

SEQ ID NO: 3759 - DNA, 32 bp, Artificial Sequence
  Synthetic polynucleotide
actgtcttgacagaagaagggccaagccattg

SEQ ID NO: 3760 - DNA, 48 bp, Artificial Sequence
  Synthetic polynucleotide
ccgcctccggtagtcattaagacggccggtgtaaccacataaagtcgt

SEQ ID NO: 3761 - DNA, 48 bp, Artificial Sequence
  Synthetic polynucleotide
gtatcatccgagtgtacgtaatgttccactcgcaatccattacggaca

SEQ ID NO: 3762 - DNA, 48 bp, Artificial Sequence
  Synthetic polynucleotide
actcaaccgagctagtcttgacaacagtgaaataggacggctataaaa

SEQ ID NO: 3763 - DNA, 48 bp, Artificial Sequence
  Synthetic polynucleotide
cgattggtttttatagggccactgccgccacaaacttcttagtagtta

SEQ ID NO: 3764 - DNA, 48 bp, Artificial Sequence
  Synthetic polynucleotide
cgcgaaggaggagcaggaccgcttcttctgtcaagacagtggacttca

SEQ ID NO: 3765 - DNA, 48 bp, Artificial Sequence
  Synthetic polynucleotide
cagactcttaaccctgttttgaaagattctaaatggagcttgcaattt

SEQ ID NO: 3766 - DNA, 48 bp, Artificial Sequence
  Synthetic polynucleotide
atagcatcgacactacgacctgcttttcgacatcgccgtttgctcgcg

SEQ ID NO: 3767 - DNA, 48 bp, Artificial Sequence
  Synthetic polynucleotide
aacgtgggaaactggtttggtatatcctgataggatctaccggcatgc

SEQ ID NO: 3768 - DNA, 48 bp, Artificial Sequence
  Synthetic polynucleotide
aagaagtttgtggcggcgacctcactatcactggaccatcggccgttt

SEQ ID NO: 3769 - DNA, 32 bp, Artificial Sequence
  Synthetic polynucleotide
cggcgccgaggcctcgtggtcggtcgcattca

SEQ ID NO: 3770 - DNA, 32 bp, Artificial Sequence
  Synthetic polynucleotide
caacacaacccggtcacgttactgaccctaac

SEQ ID NO: 3771 - DNA, 32 bp, Artificial Sequence
  Synthetic polynucleotide
tgcgaggattgctagggatgctattccagaat

SEQ ID NO: 3772 - DNA, 32 bp, Artificial Sequence
  Synthetic polynucleotide
gtagatcctatcaggagatgatactctatcac

SEQ ID NO: 3773 - DNA, 32 bp, Artificial Sequence
  Synthetic polynucleotide
cagccttccagaattacgccgtgttgttctac

SEQ ID NO: 3774 - DNA, 32 bp, Artificial Sequence
  Synthetic polynucleotide
ttaatttacgcaagctcttggacattgcgctt

SEQ ID NO: 3775 - DNA, 32 bp, Artificial Sequence
  Synthetic polynucleotide
caggcagcatcatctctcgagtctcgtaaaac

SEQ ID NO: 3776 - DNA, 32 bp, Artificial Sequence
  Synthetic polynucleotide
gattatgcttgtcgggagttggtcgatgtcaa

SEQ ID NO: 3777 - DNA, 32 bp, Artificial Sequence
  Synthetic polynucleotide
gacagaactttgtgtacccacgttgacgcccc

SEQ ID NO: 3778 - DNA, 48 bp, Artificial Sequence
  Synthetic polynucleotide
ggggtcacgagccacttaacctggcgctcagcccaccttatagcgcct

SEQ ID NO: 3779 - DNA, 48 bp, Artificial Sequence
  Synthetic polynucleotide
cgggtgtcttacgagtaacagcatggcttcattagcccggctcccggt

SEQ ID NO: 3780 - DNA, 48 bp, Artificial Sequence
  Synthetic polynucleotide
ggtacacggttccggttcagaaacaggtagagagtaattgtcgctttt

SEQ ID NO: 3781 - DNA, 48 bp, Artificial Sequence
  Synthetic polynucleotide
agttactgctaggtgggtccaacatgataatcctcgtgcttcgagaaa

SEQ ID NO: 3782 - DNA, 48 bp, Artificial Sequence
  Synthetic polynucleotide
actttctgttctggtcgttatttcacgactttacttacgtgtagtgtc

SEQ ID NO: 3783 - DNA, 48 bp, Artificial Sequence
  Synthetic polynucleotide
aacggcgatgtcgaaaggaggcggccattacgttccgcgtcaaatctg

SEQ ID NO: 3784 - DNA, 32 bp, Artificial Sequence; identical to SEQ ID NO: 50
  Synthetic polynucleotide

SEQ ID NO: 3785 - DNA, 32 bp, Artificial Sequence; identical to SEQ ID NO: 1985
  Synthetic polynucleotide

SEQ ID NO: 3786 - DNA, 32 bp, Artificial Sequence
  Synthetic polynucleotide
cacctcctgttagggtgacacccgggatgggt

SEQ ID NO: 3787 - DNA, 32 bp, Artificial Sequence
  Synthetic polynucleotide
taagacaagtagaacattgtgttgggtgtagt

SEQ ID NO: 3788 - DNA, 32 bp, Artificial Sequence
  Synthetic polynucleotide
cgcgagcaggggcgtcgaaggctgtctttgtg

SEQ ID NO: 3789 - DNA, 32 bp, Artificial Sequence
  Synthetic polynucleotide
ggttaagtttgacatctaaattaaccacctgc

SEQ ID NO: 3790 - DNA, 32 bp, Artificial Sequence; identical to SEQ ID NO: 3572
  Synthetic polynucleotide

SEQ ID NO: 3791 - DNA, 32 bp, Artificial Sequence
  Synthetic polynucleotide
cttctgcgtaactactgaacacgagcggaggg

SEQ ID NO: 3792 - DNA, 32 bp, Artificial Sequence
  Synthetic polynucleotide
tcggtcgatgaagtcccatgactctgacgccc

SEQ ID NO: 3793 - DNA, 48 bp, Artificial Sequence
  Synthetic polynucleotide
ccgggctaatgaagccgtgaccccagagactgaatcatactcacggtt

SEQ ID NO: 3794 - DNA, 48 bp, Artificial Sequence
  Synthetic polynucleotide
gcgatatctgaatgcgaccgaccaaggcgctatagggtatactcgtaa

SEQ ID NO: 3795 - DNA, 48 bp, Artificial Sequence
  Synthetic polynucleotide
ggtgcaaaaagcgcaacggcgccgattgatcaaatccgatgaccctaa

SEQ ID NO: 3796 - DNA, 48 bp, Artificial Sequence
  Synthetic polynucleotide
ctagctaggttttacgagactcgactagcacggagtttcgagcttgcg

SEQ ID NO: 3797 - DNA, 48 bp, Artificial Sequence
  Synthetic polynucleotide
ctttgaaacctgtgctgctgcctgttgtccccgtagggtaccgctggg

SEQ ID NO: 3798 - DNA, 48 bp, Artificial Sequence
  Synthetic polynucleotide
cagcttcgaaattgcaagctccatttagaatcgccatactgttgctcg

SEQ ID NO: 3799 - DNA, 32 bp, Artificial Sequence
  Synthetic polynucleotide
cgtcacttcgcgagcacgtgtcgaagtgaccg

SEQ ID NO: 3800 - DNA, 32 bp, Artificial Sequence
  Synthetic polynucleotide
gaaaactggttaatgcttgtcttagtagttaa

SEQ ID NO: 3801 - DNA, 32 bp, Artificial Sequence
  Synthetic polynucleotide
ggtattttacccatcctttgcaccacctatac

SEQ ID NO: 3802 - DNA, 32 bp, Artificial Sequence
  Synthetic polynucleotide
atcggatttgatcaatctagctagacctctct

SEQ ID NO: 3803 - DNA, 32 bp, Artificial Sequence
  Synthetic polynucleotide
taacaaggactacaccacttaaccgaggcctt

SEQ ID NO: 3804 - DNA, 32 bp, Artificial Sequence
  Synthetic polynucleotide
taacatcgttaatgggtgctcgcggggatttc

SEQ ID NO: 3805 - DNA, 32 bp, Artificial Sequence
  Synthetic polynucleotide
tcggtgacgcatgccgatattagctagcgggc

SEQ ID NO: 3806 - DNA, 32 bp, Artificial Sequence
  Synthetic polynucleotide
cctgcctacacaaagagcctcttactgccttg

SEQ ID NO: 3807 - DNA, 32 bp, Artificial Sequence
  Synthetic polynucleotide
gtgatcctgcaggtggtttcaaagtgggaccc

SEQ ID NO: 3808 - DNA, 48 bp, Artificial Sequence
  Synthetic polynucleotide
tacgggtgaaacggccgatggtccagtgatagggttgagtcttagagg

SEQ ID NO: 3809 - DNA, 48 bp, Artificial Sequence
  Synthetic polynucleotide
ctcgagcaccctccgctcgtgttccaatggctgcttaacttataccat

SEQ ID NO: 3810 - DNA, 48 bp, Artificial Sequence
  Synthetic polynucleotide
attggcttgggcgtcagagtcatgcgagcaactagggtcaagcacagg

SEQ ID NO: 3811 - DNA, 32 bp, Artificial Sequence; identical to SEQ ID NO: 1902
  Synthetic polynucleotide

SEQ ID NO: 3812 - DNA, 32 bp, Artificial Sequence; identical to SEQ ID NO: 51
  Synthetic polynucleotide

SEQ ID NO: 3813 - DNA, 32 bp, Artificial Sequence
  Synthetic polynucleotide
tgttcatcggtcaccccagttttcgcttgagg

SEQ ID NO: 3814 - DNA, 32 bp, Artificial Sequence; identical to SEQ ID NO: 2070
  Synthetic polynucleotide

SEQ ID NO: 3815 - DNA, 32 bp, Artificial Sequence
  Synthetic polynucleotide
ggattcatttaactaccgatgttattacctaa

SEQ ID NO: 3816 - DNA, 32 bp, Artificial Sequence
  Synthetic polynucleotide
cagcgcaaaaggcctctaggcagggtactgct

SEQ ID NO: 3817 - DNA, 32 bp, Artificial Sequence
  Synthetic polynucleotide
tcgtcatagggtcccaagaacggccgtctcac

SEQ ID NO: 3818 - DNA, 32 bp, Artificial Sequence
  Synthetic polynucleotide
cccagtcgcaaggcagttgtcactcatcggct

SEQ ID NO: 3819 - DNA, 32 bp, Artificial Sequence
  Synthetic polynucleotide
cgagtttgctgtatggtgctcgaggatttcaa

SEQ ID NO: 3820 - DNA, 48 bp, Artificial Sequence
  Synthetic polynucleotide
gacaaaaacagatttgacgcggaacgtaatggcagaaagtctataccc

SEQ ID NO: 3821 - DNA, 48 bp, Artificial Sequence
  Synthetic polynucleotide
aagccaagcggtcacttcgacacggtgatagatcctcgcacccattaa

SEQ ID NO: 3822 - DNA, 48 bp, Artificial Sequence
  Synthetic polynucleotide
ttaaacgtgcccgctagctaatatcctctaaggttctgtcccggagtt

SEQ ID NO: 3823 - DNA, 48 bp, Artificial Sequence
  Synthetic polynucleotide
agtgacaaaactccggcgcagaagcctaaagatgcatcacaatcgccc

SEQ ID NO: 3824 - DNA, 48 bp, Artificial Sequence
  Synthetic polynucleotide
gccgttcttccacgaatcgaccgaccatacagcaaactcgtggtgatg

SEQ ID NO: 3825 - DNA, 48 bp, Artificial Sequence
  Synthetic polynucleotide
taccctacggggacaacgaagctgttctcatttggtatcgcgtcgacc

SEQ ID NO: 3826 - DNA, 48 bp, Artificial Sequence
  Synthetic polynucleotide
tacgtgctcccaacataagtgacgtcctcagctgcgtacggcttttat

SEQ ID NO: 3827 - DNA, 48 bp, Artificial Sequence
  Synthetic polynucleotide
tgggtattgaaatcccgtcaccgaggttttctctcctgaccctttaca

SEQ ID NO: 3828 - DNA, 48 bp, Artificial Sequence
  Synthetic polynucleotide
gtgatgcatctttaggcacccgtatgtaaaatcaacaggttctggctc

SEQ ID NO: 3829 - DNA, 32 bp, Artificial Sequence
  Synthetic polynucleotide
cccggtggttagggtctcgtattaggctccaa

SEQ ID NO: 3830 - DNA, 32 bp, Artificial Sequence
  Synthetic polynucleotide
agtcaatctgccatcggatgaacacatttctt

SEQ ID NO: 3831 - DNA, 32 bp, Artificial Sequence
  Synthetic polynucleotide
tagcactattaggtaaagcacgtagagataat

SEQ ID NO: 3832 - DNA, 32 bp, Artificial Sequence
  Synthetic polynucleotide
gtcaggagagaaaacccttggctttagataag

SEQ ID NO: 3833 - DNA, 32 bp, Artificial Sequence
  Synthetic polynucleotide
catatccgagcagtacatgaatcccctgctcc

SEQ ID NO: 3834 - DNA, 32 bp, Artificial Sequence
  Synthetic polynucleotide
agtccttctgaaccctttaaccataaggtccg

SEQ ID NO: 3835 - DNA, 32 bp, Artificial Sequence
  Synthetic polynucleotide
ttaaatggcccagcggtttgctacgatatggc

SEQ ID NO: 3836 - DNA, 32 bp, Artificial Sequence
  Synthetic polynucleotide
caccggacgtgagacgttgcgctgtcccgtct

SEQ ID NO: 3837 - DNA, 32 bp, Artificial Sequence
  Synthetic polynucleotide
agcgcgccagccgatgaatacccatctgagtc

SEQ ID NO: 3838 - DNA, 48 bp, Artificial Sequence
  Synthetic polynucleotide
gagggaacaaccgtgagtatgattcagtctctgatatcgcttgtcgtt

SEQ ID NO: 3839 - DNA, 48 bp, Artificial Sequence
  Synthetic polynucleotide
ttatcatgccggcgaagcatcagatcgcgatcacactgacaccctttt

SEQ ID NO: 3840 - DNA, 48 bp, Artificial Sequence
  Synthetic polynucleotide
taggttaaacagctaagtggctggtatttcgaaggaggtggggtgacc

SEQ ID NO: 3841 - DNA, 48 bp, Artificial Sequence
  Synthetic polynucleotide
tgcttatccctcaagcctaacgatgtgggaggctaccgctaggagaaa

SEQ ID NO: 3842 - DNA, 48 bp, Artificial Sequence
  Synthetic polynucleotide
ccgcacgtgcctgtttcggaacaggggtataggcagtccgatgttggg

SEQ ID NO: 3843 - DNA, 48 bp, Artificial Sequence
  Synthetic polynucleotide
cgtacgcagctgaggatttttgtcgctgttcaccccggtaatacacaa

SEQ ID NO: 3844 - DNA, 32 bp, Artificial Sequence; identical to SEQ ID NO: 52
  Synthetic polynucleotide

SEQ ID NO: 3845 - DNA, 32 bp, Artificial Sequence; identical to SEQ ID NO: 436
  Synthetic polynucleotide

SEQ ID NO: 3846 - DNA, 32 bp, Artificial Sequence
  Synthetic polynucleotide
aatagtccaagaaatgcatgataaaagttgtg

SEQ ID NO: 3847 - DNA, 32 bp, Artificial Sequence
  Synthetic polynucleotide
taccatgaggagcagggattgactaatacatt

SEQ ID NO: 3848 - DNA, 32 bp, Artificial Sequence
  Synthetic polynucleotide
tagactttgactcagacggatatgctgtagac

SEQ ID NO: 3849 - DNA, 32 bp, Artificial Sequence
  Synthetic polynucleotide
tccatactagacgggagaaggacttgcaccaa

SEQ ID NO: 3850 - DNA, 32 bp, Artificial Sequence; identical to SEQ ID NO: 3596
  Synthetic polynucleotide

SEQ ID NO: 3851 - DNA, 32 bp, Artificial Sequence
  Synthetic polynucleotide
tatagggggggcgattaactgtccccaaacaa

SEQ ID NO: 3852 - DNA, 32 bp, Artificial Sequence
  Synthetic polynucleotide
aaggagaacatcaccatctattatttactcac

SEQ ID NO: 3853 - DNA, 48 bp, Artificial Sequence
  Synthetic polynucleotide
gtcagtgtgatcgcgagttccctctagctaggaactgttgtgtcctat

SEQ ID NO: 3854 - DNA, 48 bp, Artificial Sequence
  Synthetic polynucleotide
tccgtccgttggagcctaatacgaaacgacaaaaaataccttcgccgg

SEQ ID NO: 3855 - DNA, 48 bp, Artificial Sequence
  Synthetic polynucleotide
gcaatattcggaccttccaccgggtctgttccgagtccccgaagaata

SEQ ID NO: 3856 - DNA, 48 bp, Artificial Sequence
  Synthetic polynucleotide
cccatgccgccatatcgtagcaaaagagaggtaggatcacagggttca

SEQ ID NO: 3857 - DNA, 48 bp, Artificial Sequence
  Synthetic polynucleotide
tccaatacgggatctcccatttaatggcaaatgttgccctcgaccgat

SEQ ID NO: 3858 - DNA, 48 bp, Artificial Sequence
  Synthetic polynucleotide
cggcgcatggtcgacgcgataccaaatgagaaaagccaatcatgccat

SEQ ID NO: 3859 - DNA, 32 bp, Artificial Sequence
  Synthetic polynucleotide
gccttgtcataaaagctactgggagataaggg

SEQ ID NO: 3860 - DNA, 32 bp, Artificial Sequence
  Synthetic polynucleotide
gtgcatctggtccttctcatggtacgtgtctg

SEQ ID NO: 3861 - DNA, 32 bp, Artificial Sequence
  Synthetic polynucleotide
gcactaagcacaacttaatattgcagtattcc

SEQ ID NO: 3862 - DNA, 32 bp, Artificial Sequence
  Synthetic polynucleotide
ggggactcggaacagaggcatgggccggatgc

SEQ ID NO: 3863 - DNA, 32 bp, Artificial Sequence
  Synthetic polynucleotide
gaaggctgaatgtattagtatggatcaacccc

SEQ ID NO: 3864 - DNA, 32 bp, Artificial Sequence
  Synthetic polynucleotide
gtgtacctgaaactacaaagtctaagaaggga

SEQ ID NO: 3865 - DNA, 32 bp, Artificial Sequence
  Synthetic polynucleotide
aatccgggtgtaaaggaacgaacggcccccca

SEQ ID NO: 3866 - DNA, 32 bp, Artificial Sequence
  Synthetic polynucleotide
cagccctcgtctacagatatcgttacagagat

SEQ ID NO: 3867 - DNA, 32 bp, Artificial Sequence
  Synthetic polynucleotide
ttcctgaattggtgcagtattggagggcccgt

SEQ ID NO: 3868 - DNA, 48 bp, Artificial Sequence
  Synthetic polynucleotide
agacaacagagccagaacctgttgattttacaacgtttaaaaccccct

SEQ ID NO: 3869 - DNA, 48 bp, Artificial Sequence
  Synthetic polynucleotide
gcccttatgtagtgatcccctatactactgattacgcgaatcgatacg

SEQ ID NO: 3870 - DNA, 48 bp, Artificial Sequence
  Synthetic polynucleotide
gtttcgtattgtttggggacagttttgaaatccgactgggtccaaaag

SEQ ID NO: 3871 - DNA, 48 bp, Artificial Sequence
  Synthetic polynucleotide
ggtcaactatctcgtattctccttcaatacactaagcagactctccag

SEQ ID NO: 3872 - DNA, 48 bp, Artificial Sequence
  Synthetic polynucleotide
agtaacccgtgagtaaataatagaatggcatgtatgacgagagatccc

SEQ ID NO: 3873 - DNA, 48 bp, Artificial Sequence
  Synthetic polynucleotide
agggcaacatttgccaatgcgccggcgatttcgtcattgtttcgtcgc

SEQ ID NO: 3874 - DNA, 32 bp, Artificial Sequence; identical to SEQ ID NO: 17
  Synthetic polynucleotide

SEQ ID NO: 3875 - DNA, 32 bp, Artificial Sequence; identical to SEQ ID NO: 3607
  Synthetic polynucleotide

SEQ ID NO: 3876 - DNA, 32 bp, Artificial Sequence
  Synthetic polynucleotide
ccgcactggaatctgaagatgcaccggttctc

SEQ ID NO: 3877 - DNA, 32 bp, Artificial Sequence; identical to SEQ ID NO: 2072
  Synthetic polynucleotide

SEQ ID NO: 3878 - DNA, 32 bp, Artificial Sequence
  Synthetic polynucleotide
tatgaatccagacacgaggtacactccgggga

SEQ ID NO: 3879 - DNA, 32 bp, Artificial Sequence
  Synthetic polynucleotide
ctaaagacggggttgagagggctgtgcaaaga

SEQ ID NO: 3880 - DNA, 32 bp, Artificial Sequence
  Synthetic polynucleotide
tgtatctcacgggcccagttgaccactatcaa

SEQ ID NO: 3881 - DNA, 32 bp, Artificial Sequence; identical to SEQ ID NO: 1376
  Synthetic polynucleotide

SEQ ID NO: 3882 - DNA, 32 bp, Artificial Sequence
  Synthetic polynucleotide
tctgcttagtgtattgtacgaaacaaactgaa

SEQ ID NO: 3883 - DNA, 48 bp, Artificial Sequence
  Synthetic polynucleotide
gtatcgccttgtgtattaccggggtgaacagcacgtgcggcttctcct

SEQ ID NO: 3884 - DNA, 48 bp, Artificial Sequence
  Synthetic polynucleotide
tgtataactggcaagagacaaggccgcttcagatagcgtagaccggac

SEQ ID NO: 3885 - DNA, 48 bp, Artificial Sequence
  Synthetic polynucleotide
ctccgaaacccttatctcccagtacttatctatagtgctagtagtttc

SEQ ID NO: 3886 - DNA, 48 bp, Artificial Sequence
  Synthetic polynucleotide
ggtcggcgtcccttctcccggatttcaggtcgctccgaaatggaagtg

SEQ ID NO: 3887 - DNA, 48 bp, Artificial Sequence
  Synthetic polynucleotide
ctgggttgtggggggccgttcgttagggggttggcgcgctatcactac

SEQ ID NO: 3888 - DNA, 48 bp, Artificial Sequence
  Synthetic polynucleotide
ttcgcgtaatcagtagtgttgtctttgcgaaatagtccaggatcgaac

SEQ ID NO: 3889 - DNA, 32 bp, Artificial Sequence
  Synthetic polynucleotide
agccagagtattcttcggttcgtgcgcctccg

SEQ ID NO: 3890 - DNA, 32 bp, Artificial Sequence
  Synthetic polynucleotide
cgggtatacccgcggtcagtgcggagtaaatg

SEQ ID NO: 3891 - DNA, 32 bp, Artificial Sequence
  Synthetic polynucleotide
ctggtacttccccggagttatacaggtccggc

SEQ ID NO: 3892 - DNA, 32 bp, Artificial Sequence
  Synthetic polynucleotide
tttcggagcgacctgatttcggagccctcaca

SEQ ID NO: 3893 - DNA, 32 bp, Artificial Sequence
  Synthetic polynucleotide
aaggaacgtctttgcagattcatatcacccta

SEQ ID NO: 3894 - DNA, 32 bp, Artificial Sequence
  Synthetic polynucleotide
cccaataattactccgtgctcaatatgtgtac

SEQ ID NO: 3895 - DNA, 32 bp, Artificial Sequence
  Synthetic polynucleotide
agccgccgatcggtcgtagacattctgaggac

SEQ ID NO: 3896 - DNA, 32 bp, Artificial Sequence
  Synthetic polynucleotide
tatcaggcttgatagtgtctttagaaatgtga

SEQ ID NO: 3897 - DNA, 32 bp, Artificial Sequence
  Synthetic polynucleotide
agatgatcgaagaatccgccgaccacatatca

SEQ ID NO: 3898 - DNA, 48 bp, Artificial Sequence
  Synthetic polynucleotide
ccaggtcaataggacacaacagttcctagctacggacggagatgcgtt

SEQ ID NO: 3899 - DNA, 48 bp, Artificial Sequence
  Synthetic polynucleotide
taccgagcaaactacaggcatcacctagaaatcagagccgaggtcagg

SEQ ID NO: 3900 - DNA, 48 bp, Artificial Sequence
  Synthetic polynucleotide
cgagggttttccagctccatatccccaaggcaggactatttcagattc

SEQ ID NO: 3901 - DNA, 48 bp, Artificial Sequence
  Synthetic polynucleotide
attaatacgagaaccgatcagttaatattaaggaccatagtgtttcac

SEQ ID NO: 3902 - DNA, 48 bp, Artificial Sequence
  Synthetic polynucleotide
gctcgaccatcagctagcggaaccaggagaagtttcaacttcttgcca

SEQ ID NO: 3903 - DNA, 48 bp, Artificial Sequence
  Synthetic polynucleotide
tacgctatctgaagcgggcgataccccccgcaagagtatagatggccg

SEQ ID NO: 3904 - DNA, 32 bp, Artificial Sequence
  Synthetic polynucleotide
ctatggtccttaatataaccctcggaggcaag

SEQ ID NO: 3905 - DNA, 32 bp, Artificial Sequence; identical to SEQ ID NO: 1989
  Synthetic polynucleotide

SEQ ID NO: 3906 - DNA, 32 bp, Artificial Sequence
  Synthetic polynucleotide
gagacactcatttactgctcggtagaccatgt

SEQ ID NO: 3907 - DNA, 32 bp, Artificial Sequence
  Synthetic polynucleotide
gtagtctgtagggtgatatacccggcaagctc

SEQ ID NO: 3908 - DNA, 32 bp, Artificial Sequence
  Synthetic polynucleotide
gcacgatatgatatgtcgttccttaaggccaa

SEQ ID NO: 3909 - DNA, 32 bp, Artificial Sequence
  Synthetic polynucleotide
gaccttcctcacatttttattgggggtgaaga

SEQ ID NO: 3910 - DNA, 32 bp, Artificial Sequence; identical to SEQ ID NO: 3620
  Synthetic polynucleotide

SEQ ID NO: 3911 - DNA, 32 bp, Artificial Sequence
  Synthetic polynucleotide
cctaccatcgtatcgatgcatcggattaataa

SEQ ID NO: 3912 - DNA, 32 bp, Artificial Sequence
  Synthetic polynucleotide
cgcgcgctctggagagaagggtcgcatcggtc

SEQ ID NO: 3913 - DNA, 48 bp, Artificial Sequence
  Synthetic polynucleotide
cggctctgatttctagtgacctggtataatgggtttacttagggatgg

SEQ ID NO: 3914 - DNA, 48 bp, Artificial Sequence
  Synthetic polynucleotide
accattaccggaggcgcacgaaccaacgcatccttagtgctgtagttt

SEQ ID NO: 3915 - DNA, 48 bp, Artificial Sequence
  Synthetic polynucleotide
tctctatcgtacacatctctggctttaccaagggatattctccgccgg

SEQ ID NO: 3916 - DNA, 48 bp, Artificial Sequence
  Synthetic polynucleotide
gctccttcgtcctcagaatgtctagcatccggttcaggaacggagtaa

SEQ ID NO: 3917 - DNA, 48 bp, Artificial Sequence
  Synthetic polynucleotide
taagggtattgtcctacggcggctcaacccgttagggtgacgtattag

SEQ ID NO: 3918 - DNA, 48 bp, Artificial Sequence
  Synthetic polynucleotide
tcagtgaagcgacgaaacaatgacgaaatcgcgggttactatattgta

SEQ ID NO: 3919 - DNA, 32 bp, Artificial Sequence
  Synthetic polynucleotide
agacactagtccggtcttactgcttttacatt

SEQ ID NO: 3920 - DNA, 32 bp, Artificial Sequence
  Synthetic polynucleotide
aattagaaggcgcggccagactacggctatac

SEQ ID NO: 3921 - DNA, 32 bp, Artificial Sequence
  Synthetic polynucleotide
cgtcccatacatggtcgatagagaactgtccc

SEQ ID NO: 3922 - DNA, 32 bp, Artificial Sequence
  Synthetic polynucleotide
gaatatcccttggtaagaaggagcggcttcat

SEQ ID NO: 3923 - DNA, 32 bp, Artificial Sequence
  Synthetic polynucleotide
atgttccggagcttgcggaaggtcggtggcaa

SEQ ID NO: 3924 - DNA, 32 bp, Artificial Sequence
  Synthetic polynucleotide
gtgctgcgttttggcatatcgtgccggcatta

SEQ ID NO: 3925 - DNA, 32 bp, Artificial Sequence
  Synthetic polynucleotide
ttccatgtcacttccaaccatgcatcgaagcg

SEQ ID NO: 3926 - DNA, 32 bp, Artificial Sequence
  Synthetic polynucleotide
ggtcacacttggccttgattcgcgattgatcc

SEQ ID NO: 3927 - DNA, 32 bp, Artificial Sequence
  Synthetic polynucleotide
acattcattcttcacctacccttagacatgct

SEQ ID NO: 3928 - DNA, 48 bp, Artificial Sequence
  Synthetic polynucleotide
tccagccggttcgatcctggactatttcgcaacaacccagaaaagatg

SEQ ID NO: 3929 - DNA, 48 bp, Artificial Sequence
  Synthetic polynucleotide
gcgttcgattattaatccgatgcattcagttttcttcagggcagtttt

SEQ ID NO: 3930 - DNA, 48 bp, Artificial Sequence
  Synthetic polynucleotide
aaattcacgaccgatgcgaccctttacaatatgagatacataggacaa

SEQ ID NO: 3931 - DNA, 32 bp, Artificial Sequence; identical to SEQ ID NO: 19
  Synthetic polynucleotide

SEQ ID NO: 3932 - DNA, 32 bp, Artificial Sequence; identical to SEQ ID NO: 56
  Synthetic polynucleotide

SEQ ID NO: 3933 - DNA, 32 bp, Artificial Sequence; identical to SEQ ID NO: 2018
  Synthetic polynucleotide

SEQ ID NO: 3934 - DNA, 32 bp, Artificial Sequence; identical to SEQ ID NO: 2074
  Synthetic polynucleotide

SEQ ID NO: 3935 - DNA, 32 bp, Artificial Sequence; identical to SEQ ID NO: 2102
  Synthetic polynucleotide

SEQ ID NO: 3936 - DNA, 32 bp, Artificial Sequence; identical to SEQ ID NO: 3242
  Synthetic polynucleotide

SEQ ID NO: 3937 - DNA, 32 bp, Artificial Sequence; identical to SEQ ID NO: 1350
  Synthetic polynucleotide

SEQ ID NO: 3938 - DNA, 32 bp, Artificial Sequence; identical to SEQ ID NO: 3225
  Synthetic polynucleotide

SEQ ID NO: 3939 - DNA, 32 bp, Artificial Sequence
  Synthetic polynucleotide
attatgactgtcatattcgaacgctgtctagt

SEQ ID NO: 3940 - DNA, 48 bp, Artificial Sequence
  Synthetic polynucleotide
gtagtggccggccatctatactcttgcgggggggtcgagcgctccact

SEQ ID NO: 3941 - DNA, 48 bp, Artificial Sequence
  Synthetic polynucleotide
tgaacttcaatgtaaaagcagtaatgtgagggagtaccagtgccaaaa

SEQ ID NO: 3942 - DNA, 48 bp, Artificial Sequence
  Synthetic polynucleotide
atcctgtacgcttcgatgcatggtcatcttttgatcatctaatctaat

SEQ ID NO: 3943 - DNA, 48 bp, Artificial Sequence
  Synthetic polynucleotide
ggcgtttgattagattatggtaggggagacagcttaacgaagtggata

SEQ ID NO: 3944 - DNA, 48 bp, Artificial Sequence
  Synthetic polynucleotide
agttgcaagagacctgagcgcgcgatatgacagtcataatattgcttc

SEQ ID NO: 3945 - DNA, 48 bp, Artificial Sequence
  Synthetic polynucleotide
tcaccctaacgggttgttcactgattacggcacgggccgtcgtcaatg

SEQ ID NO: 3946 - DNA, 48 bp, Artificial Sequence
  Synthetic polynucleotide
aacggtttcccggacctagtgtctatcaagtcaaccccgtaaatcgta

SEQ ID NO: 3947 - DNA, 48 bp, Artificial Sequence
  Synthetic polynucleotide
acgcgttttaatgccgacatggaacgttatagaaactactttaggtga

SEQ ID NO: 3948 - DNA, 48 bp, Artificial Sequence
  Synthetic polynucleotide
tcgttaagctgtctcccggctggacactccaatttattggtcagcatc

SEQ ID NO: 3949 - DNA, 32 bp, Artificial Sequence
  Synthetic polynucleotide
ggttgcggccggcggaacctaatgattttata

SEQ ID NO: 3950 - DNA, 32 bp, Artificial Sequence
  Synthetic polynucleotide
tgcctaatcatcgtgctactggagcgcggaca

SEQ ID NO: 3951 - DNA, 32 bp, Artificial Sequence
  Synthetic polynucleotide
gtaacagtggagcgtaaaaccgttatggtttc

SEQ ID NO: 3952 - DNA, 32 bp, Artificial Sequence
  Synthetic polynucleotide
agtagtttctataacggaagttcagatgggag

SEQ ID NO: 3953 - DNA, 32 bp, Artificial Sequence
  Synthetic polynucleotide
cggggagcagcgctatcacttgacaccgtggg

SEQ ID NO: 3954 - DNA, 32 bp, Artificial Sequence
  Synthetic polynucleotide
atccgaagtgacgggtgttagtggtggcaccc

SEQ ID NO: 3955 - DNA, 32 bp, Artificial Sequence
  Synthetic polynucleotide
cagggtacctaatacgcgactgacgtcgatga

SEQ ID NO: 3956 - DNA, 32 bp, Artificial Sequence
  Synthetic polynucleotide
tcacatcagaatcttacgttctaggagccgat

SEQ ID NO: 3957 - DNA, 32 bp, Artificial Sequence
  Synthetic polynucleotide
tatgattacaacgctcaaacgcgtgggtaaac

SEQ ID NO: 3958 - DNA, 48 bp, Artificial Sequence
  Synthetic polynucleotide
ttcttaaaccatccctaagtaaacccattatagtaatggttataatag

SEQ ID NO: 3959 - DNA, 48 bp, Artificial Sequence
  Synthetic polynucleotide
cgctgatccgtagtggtagctccgggggatgaatccttccaacatctc

SEQ ID NO: 3960 - DNA, 48 bp, Artificial Sequence
  Synthetic polynucleotide
gaggcggcgtgggacgtatgattgcttgcctcagtgtctcaatggcaa

SEQ ID NO: 3961 - DNA, 48 bp, Artificial Sequence
  Synthetic polynucleotide
acccgagaaaagtattcctctccctgccgagggggcactcaaagcagg

SEQ ID NO: 3962 - DNA, 48 bp, Artificial Sequence
  Synthetic polynucleotide
gattgccgcccgagccaggtggccagtggagctatcctttggtccggg

SEQ ID NO: 3963 - DNA, 48 bp, Artificial Sequence
  Synthetic polynucleotide
acggggttgacttgatgccactacgcgctttctagtccacgcgtatcg

SEQ ID NO: 3964 - DNA, 32 bp, Artificial Sequence
  Synthetic polynucleotide
gagtgccccctcggcagccgcctcggttatac

SEQ ID NO: 3965 - DNA, 32 bp, Artificial Sequence; identical to SEQ ID NO: 438
  Synthetic polynucleotide

SEQ ID NO: 3966 - DNA, 32 bp, Artificial Sequence; identical to SEQ ID NO: 3261
  Synthetic polynucleotide

SEQ ID NO: 3967 - DNA, 32 bp, Artificial Sequence
  Synthetic polynucleotide
aaatactgcccacggtattaggcactccataa

SEQ ID NO: 3968 - DNA, 32 bp, Artificial Sequence
  Synthetic polynucleotide
tttgccaagtttacccgctccccgcacgggtt

SEQ ID NO: 3969 - DNA, 32 bp, Artificial Sequence
  Synthetic polynucleotide
caagggatatcggctccttcggattctctggc

SEQ ID NO: 3970 - DNA, 32 bp, Artificial Sequence
  Synthetic polynucleotide
tagccgacctctgatgtgatgtgagttgttgg

SEQ ID NO: 3971 - DNA, 32 bp, Artificial Sequence
  Synthetic polynucleotide
gattgagatatccactgtagcatacgccccca

SEQ ID NO: 3972 - DNA, 32 bp, Artificial Sequence
  Synthetic polynucleotide
tacaatgggaagcaattggcactcccctaatc

SEQ ID NO: 3973 - DNA, 48 bp, Artificial Sequence
  Synthetic polynucleotide
ggaaggattcatcccctttaagaatgatcgcatacgaactcaacgcac

SEQ ID NO: 3974 - DNA, 48 bp, Artificial Sequence
  Synthetic polynucleotide
tatcgttctataaaatcattaggtctattataatgggacgccactacg

SEQ ID NO: 3975 - DNA, 48 bp, Artificial Sequence
  Synthetic polynucleotide
tccgggatgggtgccaccgcaacctttacgtgcaagtaagcagggcgt

SEQ ID NO: 3976 - DNA, 48 bp, Artificial Sequence
  Synthetic polynucleotide
cagttttctcatcgacgtcagtcgatgaagccatgaatgtacccgtca

SEQ ID NO: 3977 - DNA, 48 bp, Artificial Sequence
  Synthetic polynucleotide
agttagcattacgcgggtaccctggaccgctaacctcttagcacaata

SEQ ID NO: 3978 - DNA, 48 bp, Artificial Sequence
  Synthetic polynucleotide
taggcccccattgacgacggcccgtgccgtaagtgaattttgcgccca

SEQ ID NO: 3979 - DNA, 32 bp, Artificial Sequence
  Synthetic polynucleotide
gcttctcgtacgatttgggagacatttcgggt

SEQ ID NO: 3980 - DNA, 32 bp, Artificial Sequence
  Synthetic polynucleotide
gtgcgcttcccgctcgcagtatttacttcctg

SEQ ID NO: 3981 - DNA, 32 bp, Artificial Sequence
  Synthetic polynucleotide
actgaaaggtcgaattatcccggatcttgtat

SEQ ID NO: 3982 - DNA, 32 bp, Artificial Sequence
  Synthetic polynucleotide
cttacttgcacgtaaagaaaactggcaatagg

SEQ ID NO: 3983 - DNA, 32 bp, Artificial Sequence
  Synthetic polynucleotide
ctgctgaattatggagatcccttgctcccgaa

SEQ ID NO: 3984 - DNA, 32 bp, Artificial Sequence
  Synthetic polynucleotide
cacaaaaccagcgcggttggcaaaaaccgcgt

SEQ ID NO: 3985 - DNA, 32 bp, Artificial Sequence
  Synthetic polynucleotide
ttcgtgtgtcacctaaccagagatatggccta

SEQ ID NO: 3986 - DNA, 32 bp, Artificial Sequence
  Synthetic polynucleotide
attactttaacccgtggtcggctagcctcata

SEQ ID NO: 3987 - DNA, 32 bp, Artificial Sequence
  Synthetic polynucleotide
gccatacagccagagatgctaactgtatgacg

SEQ ID NO: 3988 - DNA, 48 bp, Artificial Sequence
  Synthetic polynucleotide
tcgcaccagatgctgaccaataaattggagtgtacaggattcggcgac

SEQ ID NO: 3989 - DNA, 48 bp, Artificial Sequence
  Synthetic polynucleotide
cccatctttctaggtttctcaatcgatatgtggtggaacattgcgaaa

SEQ ID NO: 3990 - DNA, 48 bp, Artificial Sequence
  Synthetic polynucleotide
ctaagacctgggggcgtatgctacactagacaacctcgcccatcagag

SEQ ID NO: 3991 - DNA, 48 bp, Artificial Sequence
  Synthetic polynucleotide
accttttaccaacaacccattgtaagcccacctagcgggtgcatttgt

SEQ ID NO: 3992 - DNA, 48 bp, Artificial Sequence
  Synthetic polynucleotide
cttgcggggattaggggagtgccatgggcgcataacctgcccgcgtaa

SEQ ID NO: 3993 - DNA, 48 bp, Artificial Sequence
  Synthetic polynucleotide
taagaggttagcggtcggggcctaggcgagactggctcggtggtaagt

SEQ ID NO: 3994 - DNA, 32 bp, Artificial Sequence; identical to SEQ ID NO: 21
  Synthetic polynucleotide

SEQ ID NO: 3995 - DNA, 32 bp, Artificial Sequence; identical to SEQ ID NO: 59
  Synthetic polynucleotide

SEQ ID NO: 3996 - DNA, 32 bp, Artificial Sequence; identical to SEQ ID NO: 3635
  Synthetic polynucleotide

SEQ ID NO: 3997 - DNA, 32 bp, Artificial Sequence; identical to SEQ ID NO: 2076
  Synthetic polynucleotide

SEQ ID NO: 3998 - DNA, 32 bp, Artificial Sequence
  Synthetic polynucleotide
aggcgtctcaggaagtgttttgtgctcgacaa

SEQ ID NO: 3999 - DNA, 32 bp, Artificial Sequence
  Synthetic polynucleotide
cttacactttcgggagaaagtaatatgggttg

SEQ ID NO: 4000 - DNA, 32 bp, Artificial Sequence; identical to SEQ ID NO: 1352
  Synthetic polynucleotide

SEQ ID NO: 4001 - DNA, 32 bp, Artificial Sequence
  Synthetic polynucleotide
gttgtgtctatgaggcaagatggggacaggac

SEQ ID NO: 4002 - DNA, 32 bp, Artificial Sequence; identical to SEQ ID NO: 1582
  Synthetic polynucleotide

SEQ ID NO: 4003 - DNA, 48 bp, Artificial Sequence
  Synthetic polynucleotide
gctacctccgatacgcgtggactagaaagcgccggcaatctgaatatc

SEQ ID NO: 4004 - DNA, 48 bp, Artificial Sequence
  Synthetic polynucleotide
tcactgttgtgacctacgagaagcgtatagatagagtcgttatgcccc

SEQ ID NO: 4005 - DNA, 48 bp, Artificial Sequence
  Synthetic polynucleotide
gaatcataacccgaaatgtctcccctcccatcactgttacccgcgctg

SEQ ID NO: 4006 - DNA, 48 bp, Artificial Sequence
  Synthetic polynucleotide
ttgtacccacgcggttcacacgaattcgggggtaatctcatttttaac

SEQ ID NO: 4007 - DNA, 48 bp, Artificial Sequence
  Synthetic polynucleotide
tgatgggctaggccatatctctgggtcgccgataatcataaacctaga

SEQ ID NO: 4008 - DNA, 48 bp, Artificial Sequence
  Synthetic polynucleotide
tgttccaccacatatctggtgcgattttcgaattctgtttagaggcga

SEQ ID NO: 4009 - DNA, 32 bp, Artificial Sequence
  Synthetic polynucleotide
gttgttccacgccctgacagtgccaggctgcg

SEQ ID NO: 4010 - DNA, 32 bp, Artificial Sequence
  Synthetic polynucleotide
tggtcgcggagtaaggaccattgttattggcc

SEQ ID NO: 4011 - DNA, 32 bp, Artificial Sequence
  Synthetic polynucleotide
gagatgtattgtcgagaacagtgagctattcg

SEQ ID NO: 4012 - DNA, 32 bp, Artificial Sequence
  Synthetic polynucleotide
tgagattacccccgaatatgattcaacactcc

SEQ ID NO: 4013 - DNA, 32 bp, Artificial Sequence
  Synthetic polynucleotide
tgccacaccaacccatagacgcctccgcagag

SEQ ID NO: 4014 - DNA, 32 bp, Artificial Sequence
  Synthetic polynucleotide
ttgtgatctattagtatccctaaatgtccgtg

SEQ ID NO: 4015 - DNA, 32 bp, Artificial Sequence
  Synthetic polynucleotide
ccagaccgtattgtgcaattatccagcattcc

SEQ ID NO: 4016 - DNA, 32 bp, Artificial Sequence
  Synthetic polynucleotide
atgtgaagttacttctagtgtaagttgctata

SEQ ID NO: 4017 - DNA, 32 bp, Artificial Sequence
  Synthetic polynucleotide
cgcgaagcgtcctgtcgggtacaaagatctag

SEQ ID NO: 4018 - DNA, 48 bp, Artificial Sequence
  Synthetic polynucleotide
caccagaagtgcgttgagttcgtatgcgatcagaacgatagcgccgtg

SEQ ID NO: 4019 - DNA, 48 bp, Artificial Sequence
  Synthetic polynucleotide
ccacaaagacactcacaaagactgtgcgagatctttacgcgcttgaac

SEQ ID NO: 4020 - DNA, 48 bp, Artificial Sequence
  Synthetic polynucleotide
agtacgaccaaccaaaagatgttcgtataaccttatattacaaaagat

SEQ ID NO: 4021 - DNA, 48 bp, Artificial Sequence
  Synthetic polynucleotide
gcctgtgacggtttaccttgacgatcacgtggaatgcacatcgggcac

SEQ ID NO: 4022 - DNA, 48 bp, Artificial Sequence
  Synthetic polynucleotide
cctactctatcgggttagctatgggatattcaatagaatataggtcac

SEQ ID NO: 4023 - DNA, 48 bp, Artificial Sequence
  Synthetic polynucleotide
acgactctatctatacgaggtagctaaatggttctggttccccactgt

SEQ ID NO: 4024 - DNA, 32 bp, Artificial Sequence; identical to SEQ ID NO: 60
  Synthetic polynucleotide

SEQ ID NO: 4025 - DNA, 32 bp, Artificial Sequence; identical to SEQ ID NO: 439
  Synthetic polynucleotide

SEQ ID NO: 4026 - DNA, 32 bp, Artificial Sequence; identical to SEQ ID NO: 3283
  Synthetic polynucleotide

SEQ ID NO: 4027 - DNA, 32 bp, Artificial Sequence
  Synthetic polynucleotide
taccctccctctgcggcgcgaccacattggca

SEQ ID NO: 4028 - DNA, 32 bp, Artificial Sequence
  Synthetic polynucleotide
cgaccgctctagatctgtgtggcacctgttag

SEQ ID NO: 4029 - DNA, 32 bp, Artificial Sequence
  Synthetic polynucleotide
cactaaactatagcaagatcacaaatatggca

SEQ ID NO: 4030 - DNA, 32 bp, Artificial Sequence
  Synthetic polynucleotide
tttggtaatggacggtcttcacatgttcccta

SEQ ID NO: 4031 - DNA, 32 bp, Artificial Sequence
  Synthetic polynucleotide
atccgacctttcgcaactcgaccgatcggctt

SEQ ID NO: 4032 - DNA, 32 bp, Artificial Sequence
  Synthetic polynucleotide
gggggtggacaaatgcgagttatcttgcggtc

SEQ ID NO: 4033 - DNA, 48 bp, Artificial Sequence
  Synthetic polynucleotide
gcgtaaagatctcgcattctggtgccaaaactgctcgggtagtctcaa

SEQ ID NO: 4034 - DNA, 48 bp, Artificial Sequence
  Synthetic polynucleotide
gatgacctcgcagcctggcactgtcacggcgcctttcagtgtgagtgt

SEQ ID NO: 4035 - DNA, 48 bp, Artificial Sequence
  Synthetic polynucleotide
agcaatatcacggacaggaacaacgggtgtcaaaaagcagtcaaccgg

SEQ ID NO: 4036 - DNA, 48 bp, Artificial Sequence
  Synthetic polynucleotide
ttccccggggaatgctggataattcctattgctgtatggctactaata

SEQ ID NO: 4037 - DNA, 48 bp, Artificial Sequence
  Synthetic polynucleotide
cagtccgacctaggagcggtctggctgtgaggagcagaatggtataaa

SEQ ID NO: 4038 - DNA, 48 bp, Artificial Sequence
  Synthetic polynucleotide
gaacctttacttaccaccgagccagtctcgcccccgcaagtagtctcg

SEQ ID NO: 4039 - DNA, 32 bp, Artificial Sequence
  Synthetic polynucleotide
gaggagcgggggcatatggccctttggtggat

SEQ ID NO: 4040 - DNA, 32 bp, Artificial Sequence
  Synthetic polynucleotide
gggagctgcgtagttcggagggtatggagtag

SEQ ID NO: 4041 - DNA, 32 bp, Artificial Sequence
  Synthetic polynucleotide
gatgatatatagtggaatattgctttgccctt

SEQ ID NO: 4042 - DNA, 32 bp, Artificial Sequence
  Synthetic polynucleotide
ctgctttttgacacccccggggaacccgaagc

SEQ ID NO: 4043 - DNA, 32 bp, Artificial Sequence
  Synthetic polynucleotide
aaatacgatgccaatggtttagtgccctccca

SEQ ID NO: 4044 - DNA, 32 bp, Artificial Sequence
  Synthetic polynucleotide
caggtggtggacgagcagcggtcgccgtcatg

SEQ ID NO: 4045 - DNA, 32 bp, Artificial Sequence
  Synthetic polynucleotide
agcgatgggttaaaaaaaatcagttgtcgtga

SEQ ID NO: 4046 - DNA, 32 bp, Artificial Sequence
  Synthetic polynucleotide
tgttgaggctaacaggttaccaaactcccata

SEQ ID NO: 4047 - DNA, 32 bp, Artificial Sequence
  Synthetic polynucleotide
ttggtttatgccatattcggactgtgggcgta

SEQ ID NO: 4048 - DNA, 48 bp, Artificial Sequence
  Synthetic polynucleotide
attcaccatcgcctctaaacagaattcgaaaagcccatcaccggacga

SEQ ID NO: 4049 - DNA, 48 bp, Artificial Sequence
  Synthetic polynucleotide
ttacaatcccaacaggggtcggatatgagtgaaatgtcttgacgtggg

SEQ ID NO: 4050 - DNA, 48 bp, Artificial Sequence
  Synthetic polynucleotide
ggctgcacaagccgatcggtcgaggaattgacgacacaacaccgtcca

SEQ ID NO: 4051 - DNA, 48 bp, Artificial Sequence
  Synthetic polynucleotide
gtagtttatagggaacccacccccgacttcagagcccccgaatttggg

SEQ ID NO: 4052 - DNA, 48 bp, Artificial Sequence
  Synthetic polynucleotide
tgcgataagaccgcaagataactccgagactagaccaggtctcctagg

SEQ ID NO: 4053 - DNA, 48 bp, Artificial Sequence
  Synthetic polynucleotide
attctgctcctcacagaaaggttcggcggcgtcagcacgcagaaggtt

SEQ ID NO: 4054 - DNA, 32 bp, Artificial Sequence; identical to SEQ ID NO: 23
  Synthetic polynucleotide

SEQ ID NO: 4055 - DNA, 32 bp, Artificial Sequence; identical to SEQ ID NO: 61
  Synthetic polynucleotide

SEQ ID NO: 4056 - DNA, 32 bp, Artificial Sequence; identical to SEQ ID NO: 3649
  Synthetic polynucleotide

SEQ ID NO: 4057 - DNA, 32 bp, Artificial Sequence
  Synthetic polynucleotide
gtccaagtaagggcaatcgtatttgatgcccg

SEQ ID NO: 4058 - DNA, 32 bp, Artificial Sequence
  Synthetic polynucleotide
ctataagactactccaaccacctgttgaccga

SEQ ID NO: 4059 - DNA, 32 bp, Artificial Sequence; identical to SEQ ID NO: 1298
  Synthetic polynucleotide

SEQ ID NO: 4060 - DNA, 32 bp, Artificial Sequence; identical to SEQ ID NO: 3651
  Synthetic polynucleotide

SEQ ID NO: 4061 - DNA, 32 bp, Artificial Sequence
  Synthetic polynucleotide
agttcggttatgggaggattgtaagactactt

SEQ ID NO: 4062 - DNA, 32 bp, Artificial Sequence; identical to SEQ ID NO: 1584
  Synthetic polynucleotide

SEQ ID NO: 4063 - DNA, 48 bp, Artificial Sequence
  Synthetic polynucleotide
tcagccaaacagtggggaaccagaaccatttaagagtaggggcagtgc

SEQ ID NO: 4064 - DNA, 48 bp, Artificial Sequence
  Synthetic polynucleotide
tatgaattggtttaaacgctcctcgggaattaccggttctgctagagt

SEQ ID NO: 4065 - DNA, 48 bp, Artificial Sequence
  Synthetic polynucleotide
tcaccataatccaccaaagggccaggagtgtttacatctcgctcgtcc

SEQ ID NO: 4066 - DNA, 48 bp, Artificial Sequence
  Synthetic polynucleotide
cgcggtgacatgacggccatcgctgataaaggtgttatatgatatttg

SEQ ID NO: 4067 - DNA, 48 bp, Artificial Sequence
  Synthetic polynucleotide
ccgatcattcacgacaactgattttcgtccgggcttcgcgcctgttgg

SEQ ID NO: 4068 - DNA, 48 bp, Artificial Sequence
  Synthetic polynucleotide
aagacatttcactcattggtgaatggtatacggacctctgtctgggtt

SEQ ID NO: 4069 - DNA, 32 bp, Artificial Sequence
  Synthetic polynucleotide
gcgccagaccggttgagctgtgccatgtgaag

SEQ ID NO: 4070 - DNA, 32 bp, Artificial Sequence
  Synthetic polynucleotide
tcacgaggcgggcatcacctatatagccattt

SEQ ID NO: 4071 - DNA, 32 bp, Artificial Sequence
  Synthetic polynucleotide
tatcattgtcggtcaaaattcatattgccacc

SEQ ID NO: 4072 - DNA, 32 bp, Artificial Sequence
  Synthetic polynucleotide
atataacacctttatctatggtgaagtttcac

SEQ ID NO: 4073 - DNA, 32 bp, Artificial Sequence
  Synthetic polynucleotide
cgagttgaattcaagatcttatagttttctta

SEQ ID NO: 4074 - DNA, 32 bp, Artificial Sequence
  Synthetic polynucleotide
ccatatcatgacccttacttggacaaagtgag

SEQ ID NO: 4075 - DNA, 32 bp, Artificial Sequence
  Synthetic polynucleotide
cgtggatctttataccaggtaactcccgttta

SEQ ID NO: 4076 - DNA, 32 bp, Artificial Sequence
  Synthetic polynucleotide
gtccaggcgtggaaaagactttgtgtaatctc

SEQ ID NO: 4077 - DNA, 32 bp, Artificial Sequence
  Synthetic polynucleotide
gaagttttaagtagtctcaccgcgtagtgttg

SEQ ID NO: 4078 - DNA, 48 bp, Artificial Sequence
  Synthetic polynucleotide
agcttgggttgagactacccgagcagttttggaggtcatcatcgccaa

SEQ ID NO: 4079 - DNA, 48 bp, Artificial Sequence
  Synthetic polynucleotide
cgaccattacattgtagagtcggcctgacagacatcttttggggtcgt

SEQ ID NO: 4080 - DNA, 48 bp, Artificial Sequence
  Synthetic polynucleotide
cacttgagatagccagataatagtttgctttacaggcaagggtgtcag

SEQ ID NO: 4081 - DNA, 48 bp, Artificial Sequence
  Synthetic polynucleotide
gaggtggtacttaccttcccacgtacaacatagtgggtaagttatgga

SEQ ID NO: 4082 - DNA, 48 bp, Artificial Sequence
  Synthetic polynucleotide
acttgggaaccatacctcagacgcgcactgcccgcggaactttaaacc

SEQ ID NO: 4083 - DNA, 48 bp, Artificial Sequence
  Synthetic polynucleotide
agaaccggtaattcccttggctgacacctttccgagatgttctcataa

SEQ ID NO: 4084 - DNA, 32 bp, Artificial Sequence; identical to SEQ ID NO: 62
  Synthetic polynucleotide

SEQ ID NO: 4085 - DNA, 32 bp, Artificial Sequence; identical to SEQ ID NO: 442
  Synthetic polynucleotide

SEQ ID NO: 4086 - DNA, 32 bp, Artificial Sequence; identical to SEQ ID NO: 2022
  Synthetic polynucleotide

SEQ ID NO: 4087 - DNA, 32 bp, Artificial Sequence
  Synthetic polynucleotide
tccagagctaagaaaacctcgtgatatcagag

SEQ ID NO: 4088 - DNA, 32 bp, Artificial Sequence
  Synthetic polynucleotide
gctcttaacaacactatcaactcgtacacact

SEQ ID NO: 4089 - DNA, 32 bp, Artificial Sequence
  Synthetic polynucleotide
gatcctgagagattactgatatggtccaaaat

SEQ ID NO: 4090 - DNA, 32 bp, Artificial Sequence
  Synthetic polynucleotide
tactcaaaaggtacctgcctggaccatttatt

SEQ ID NO: 4091 - DNA, 32 bp, Artificial Sequence
  Synthetic polynucleotide
aagcatggcccacgtcccagtctgacctctat

SEQ ID NO: 4092 - DNA, 32 bp, Artificial Sequence
  Synthetic polynucleotide
gaactaaccccaaattgacttaggccggatgg

SEQ ID NO: 4093 - DNA, 48 bp, Artificial Sequence
  Synthetic polynucleotide
aaaagatgtctgtcagcccaagcttagcataagaagatagagagcata

SEQ ID NO: 4094 - DNA, 48 bp, Artificial Sequence
  Synthetic polynucleotide
gtctgacccttcacatggcacagcttggcgatatatcatctacaatgt

SEQ ID NO: 4095 - DNA, 48 bp, Artificial Sequence
  Synthetic polynucleotide
tgtgtatgctcacttttctggcgccggcttagcgacgagtaacggcat

SEQ ID NO: 4096 - DNA, 48 bp, Artificial Sequence
  Synthetic polynucleotide
cggtacagtaaacgggagttacctgcttcgggtaaaccaaaagggtca

SEQ ID NO: 4097 - DNA, 48 bp, Artificial Sequence
  Synthetic polynucleotide
cgtccagcgcatctgtgatccacgtcagatttgcaataaagaaactgc

SEQ ID NO: 4098 - DNA, 48 bp, Artificial Sequence
  Synthetic polynucleotide
gagttattaaccttctgcgtgctgacgccgccttatcgcattattcct

SEQ ID NO: 4099 - DNA, 32 bp, Artificial Sequence
  Synthetic polynucleotide
tcacagtgactctagcattaccttcaccgctc

SEQ ID NO: 4100 - DNA, 32 bp, Artificial Sequence
  Synthetic polynucleotide
atcgctcatgacatcggctctggagcgaccga

SEQ ID NO: 4101 - DNA, 32 bp, Artificial Sequence
  Synthetic polynucleotide
tattgaagcatattgtcatacacaccacaatg

SEQ ID NO: 4102 - DNA, 32 bp, Artificial Sequence
  Synthetic polynucleotide
actcgtcgctaagccgctgtaccgggttatgc

SEQ ID NO: 4103 - DNA, 32 bp, Artificial Sequence
  Synthetic polynucleotide
gcggcgaactctgatatcaggatcgtgtttcc

SEQ ID NO: 4104 - DNA, 32 bp, Artificial Sequence
  Synthetic polynucleotide
tgcataccatccgtcattaagagccgggcgac

SEQ ID NO: 4105 - DNA, 32 bp, Artificial Sequence
  Synthetic polynucleotide
acttgattcaaatatcgggagattgcgactca

SEQ ID NO: 4106 - DNA, 32 bp, Artificial Sequence
  Synthetic polynucleotide
cgggcccaagtgtgtatttgagtaattcctca

SEQ ID NO: 4107 - DNA, 32 bp, Artificial Sequence
  Synthetic polynucleotide
cggactaaattttggagctggacgtgcgcgag

SEQ ID NO: 4108 - DNA, 48 bp, Artificial Sequence
  Synthetic polynucleotide
ggcacaacaacccagacagaggtccgtataccatgatcggcatctagc

SEQ ID NO: 4109 - DNA, 48 bp, Artificial Sequence
  Synthetic polynucleotide
ccgtcctctcatatgtccatgctttctattctgacgagtatccggttt

SEQ ID NO: 4110 - DNA, 48 bp, Artificial Sequence
  Synthetic polynucleotide
gagaggtgatagaggtcagactggatcacgacaccgaactaggtacct

SEQ ID NO: 4111 - DNA, 48 bp, Artificial Sequence
  Synthetic polynucleotide
ctgagcgtaataaatggttagttctacaaattttccgattttcccttt

SEQ ID NO: 4112 - DNA, 48 bp, Artificial Sequence
  Synthetic polynucleotide
atcgcaacccatccggcctaagtcaggaataacctacaccacagatgc

SEQ ID NO: 4113 - DNA, 48 bp, Artificial Sequence
  Synthetic polynucleotide
tttattgcaaatctgaaataactcgccgaagtactgaccgggtgtcac

SEQ ID NO: 4114 - DNA, 32 bp, Artificial Sequence; identical to SEQ ID NO: 3319
  Synthetic polynucleotide

SEQ ID NO: 4115 - DNA, 32 bp, Artificial Sequence; identical to SEQ ID NO: 63
  Synthetic polynucleotide

SEQ ID NO: 4116 - DNA, 32 bp, Artificial Sequence; identical to SEQ ID NO: 1014
  Synthetic polynucleotide

SEQ ID NO: 4117 - DNA, 32 bp, Artificial Sequence; identical to SEQ ID NO: 3664
  Synthetic polynucleotide

SEQ ID NO: 4118 - DNA, 32 bp, Artificial Sequence
  Synthetic polynucleotide
gtcgtaactcggtcgcggtatgcattggctca

SEQ ID NO: 4119 - DNA, 32 bp, Artificial Sequence; identical to SEQ ID NO: 1300
  Synthetic polynucleotide

SEQ ID NO: 4120 - DNA, 32 bp, Artificial Sequence
  Synthetic polynucleotide
atacgtgcctcgcgcaacgctcagccggtctg

SEQ ID NO: 4121 - DNA, 32 bp, Artificial Sequence
  Synthetic polynucleotide
gggttcattgaggaatgaggacggtaaccaaa

SEQ ID NO: 4122 - DNA, 32 bp, Artificial Sequence
  Synthetic polynucleotide
aatcggaaaatttgtacacctctcgcttgcca

SEQ ID NO: 4123 - DNA, 48 bp, Artificial Sequence
  Synthetic polynucleotide
aaaaggaattatgagaacatctcggaaaggtgtcccaagtgcaagtaa

SEQ ID NO: 4124 - DNA, 48 bp, Artificial Sequence
  Synthetic polynucleotide
gcgccgcatacccattcactgtgaatttccacgggactggatcagatg

SEQ ID NO: 4125 - DNA, 48 bp, Artificial Sequence
  Synthetic polynucleotide
gtgctcttgagcggtgaaggtaatgtgaaactcaatgatatgacggat

SEQ ID NO: 4126 - DNA, 48 bp, Artificial Sequence
  Synthetic polynucleotide
cgtcactagtcgcccgaatcaagtagggcgaagggttatacaccgtgt

SEQ ID NO: 4127 - DNA, 48 bp, Artificial Sequence
  Synthetic polynucleotide
ctcagcaatgagtcgcaatctcccgctagatgaaaacttcacatatga

SEQ ID NO: 4128 - DNA, 48 bp, Artificial Sequence
  Synthetic polynucleotide
tactcgtcagaatagagttgtgccccaaagtttacgtatagaggtccg

SEQ ID NO: 4129 - DNA, 32 bp, Artificial Sequence
  Synthetic polynucleotide
cgtcctgtatgccgttccatattaacctgcca

SEQ ID NO: 4130 - DNA, 32 bp, Artificial Sequence
  Synthetic polynucleotide
cgcgagacaaaacgacacttaatattcaggct

SEQ ID NO: 4131 - DNA, 32 bp, Artificial Sequence
  Synthetic polynucleotide
gcctcagttgagccaatgcggcgccctgcgaa

SEQ ID NO: 4132 - DNA, 32 bp, Artificial Sequence
  Synthetic polynucleotide
tataacccttcgccctaagagcacgaagcgag

SEQ ID NO: 4133 - DNA, 32 bp, Artificial Sequence
  Synthetic polynucleotide
acgttgttacaaacccgttacgacgaaatact

SEQ ID NO: 4134 - DNA, 32 bp, Artificial Sequence
  Synthetic polynucleotide
gtgtaagacactaatacgtgacggtgaatctt

SEQ ID NO: 4135 - DNA, 32 bp, Artificial Sequence
  Synthetic polynucleotide
attcccaggcagtttctattattatttcaggt

SEQ ID NO: 4136 - DNA, 32 bp, Artificial Sequence
  Synthetic polynucleotide
gcatgctgcagaccggcgttgcacattgtacc

SEQ ID NO: 4137 - DNA, 32 bp, Artificial Sequence
  Synthetic polynucleotide
aaactaaatttggttatagtgacgcggggcat

SEQ ID NO: 4138 - DNA, 48 bp, Artificial Sequence
  Synthetic polynucleotide
cgtttgtctatgctctctatcttcttatgctaggtcagacggtaatcc

SEQ ID NO: 4139 - DNA, 48 bp, Artificial Sequence
  Synthetic polynucleotide
gcagggtgctacaactccagccgcgcgcagggctcgacggttaatttg

SEQ ID NO: 4140 - DNA, 48 bp, Artificial Sequence
  Synthetic polynucleotide
atgtagcatcagtcgtcgcacggcactgttagctctccgccggcgaaa

SEQ ID NO: 4141 - DNA, 48 bp, Artificial Sequence
  Synthetic polynucleotide
cccatggaggtcattgtaattagtacggccaccggtgagattccccag

SEQ ID NO: 4142 - DNA, 48 bp, Artificial Sequence
  Synthetic polynucleotide
cagaaactatccctgacgtgcacattacttgctgtcgtataatgggta

SEQ ID NO: 4143 - DNA, 48 bp, Artificial Sequence
  Synthetic polynucleotide
ccagtcccgtggaaatttccttttttaggatcccacatgaaccgctct

SEQ ID NO: 4144 - DNA, 32 bp, Artificial Sequence; identical to SEQ ID NO: 64
  Synthetic polynucleotide

SEQ ID NO: 4145 - DNA, 32 bp, Artificial Sequence
  Synthetic polynucleotide
accgaggattcgcaggtccatgggattcacca

SEQ ID NO: 4146 - DNA, 32 bp, Artificial Sequence; identical to SEQ ID NO: 3331
  Synthetic polynucleotide

SEQ ID NO: 4147 - DNA, 32 bp, Artificial Sequence
  Synthetic polynucleotide
aaacgtctagtatttcgtctcgcgagacgcta

SEQ ID NO: 4148 - DNA, 32 bp, Artificial Sequence
  Synthetic polynucleotide
taccgcaaatgccccgaacaacgtgtctcatt

SEQ ID NO: 4149 - DNA, 32 bp, Artificial Sequence
  Synthetic polynucleotide
tgtttactggtacaattcttacacgggtagga

SEQ ID NO: 4150 - DNA, 32 bp, Artificial Sequence
  Synthetic polynucleotide
agggcactgacgacgccagcatgcccggttta

SEQ ID NO: 4151 - DNA, 32 bp, Artificial Sequence
  Synthetic polynucleotide
gatgctggaaaccggataacctaaaaaggaaa

SEQ ID NO: 4152 - DNA, 32 bp, Artificial Sequence
  Synthetic polynucleotide
tgactgtaaaagggaacagagagtgataccct

SEQ ID NO: 4153 - DNA, 48 bp, Artificial Sequence
  Synthetic polynucleotide
ccgtcgagccctgcgcgacaaacgcatatcctaattcgctaaaccgga

SEQ ID NO: 4154 - DNA, 48 bp, Artificial Sequence
  Synthetic polynucleotide
gcatcagctggcaggttaatatggggattacccttcaataagttgtag

SEQ ID NO: 4155 - DNA, 48 bp, Artificial Sequence
  Synthetic polynucleotide
ctcagtttaagattcaacaggacgatgttctccttccgactttttata

SEQ ID NO: 4156 - DNA, 48 bp, Artificial Sequence
  Synthetic polynucleotide
gctaacttacctgaaataataatagcataaccttagtccgtattagtg

SEQ ID NO: 4157 - DNA, 48 bp, Artificial Sequence
  Synthetic polynucleotide
gctagcatctcaagacctgggaattaggtaagactcctactgcccgcc

SEQ ID NO: 4158 - DNA, 48 bp, Artificial Sequence
  Synthetic polynucleotide
agtgtagtgtgacacccggtcagtacttcggcgttgcgataatagccc

SEQ ID NO: 4159 - DNA, 32 bp, Artificial Sequence
  Synthetic polynucleotide
ggagaatccatctgatgctcttaagcaggtta

SEQ ID NO: 4160 - DNA, 32 bp, Artificial Sequence
  Synthetic polynucleotide
gaattatatggtgaatagacgtttcctcacgc

SEQ ID NO: 4161 - DNA, 32 bp, Artificial Sequence
  Synthetic polynucleotide
gcatgagaccgtcgataaactgagtaagacct

SEQ ID NO: 4162 - DNA, 32 bp, Artificial Sequence
  Synthetic polynucleotide
gtcggaaggagaacataagttagctggatact

SEQ ID NO: 4163 - DNA, 32 bp, Artificial Sequence
  Synthetic polynucleotide
gccaaaattagcgtctagtaaacaatcaagga

SEQ ID NO: 4164 - DNA, 32 bp, Artificial Sequence
  Synthetic polynucleotide
ggcccatagttaactcttgcggtaacggctag

SEQ ID NO: 4165 - DNA, 32 bp, Artificial Sequence
  Synthetic polynucleotide
cctatcacacacggtgcgactcaatgacgttt

SEQ ID NO: 4166 - DNA, 32 bp, Artificial Sequence
  Synthetic polynucleotide
cttatcctaatgagacagtgcccttatgccta

SEQ ID NO: 4167 - DNA, 32 bp, Artificial Sequence
  Synthetic polynucleotide
tgacactttcctacccatgctagcgccacacg

SEQ ID NO: 4168 - DNA, 48 bp, Artificial Sequence
  Synthetic polynucleotide
tcttatggcggacctctatacgtaaactttggttgctgagttatccac

SEQ ID NO: 4169 - DNA, 48 bp, Artificial Sequence
  Synthetic polynucleotide
ctgttctttttcctttttaggttatggcaagcatgaacccgcgtcgtc

SEQ ID NO: 4170 - DNA, 48 bp, Artificial Sequence
  Synthetic polynucleotide
atcgggctagggtatcactctctggggctattgcacgtatgtcttgag

SEQ ID NO: 4171 - DNA, 32 bp, Artificial Sequence; identical to SEQ ID NO: 28
  Synthetic polynucleotide

SEQ ID NO: 4172 - DNA, 32 bp, Artificial Sequence; identical to SEQ ID NO: 65
  Synthetic polynucleotide

SEQ ID NO: 4173 - DNA, 32 bp, Artificial Sequence; identical to SEQ ID NO: 1016
  Synthetic polynucleotide

SEQ ID NO: 4174 - DNA, 32 bp, Artificial Sequence
  Synthetic polynucleotide
acctcttcaggtcttaattttggcggaacggg

SEQ ID NO: 4175 - DNA, 32 bp, Artificial Sequence
  Synthetic polynucleotide
tagactcagcgtgaggtatgggcctcatcccc

SEQ ID NO: 4176 - DNA, 32 bp, Artificial Sequence
  Synthetic polynucleotide
gcgcagtttccttgataggataaggcagtgac

SEQ ID NO: 4177 - DNA, 32 bp, Artificial Sequence; identical to SEQ ID NO: 3665
  Synthetic polynucleotide

SEQ ID NO: 4178 - DNA, 32 bp, Artificial Sequence
  Synthetic polynucleotide
cattcctataggcatagtgcgctaaaggtatt

SEQ ID NO: 4179 - DNA, 32 bp, Artificial Sequence
  Synthetic polynucleotide
caaccagggcctgcaaaagaacagttccgtgc

SEQ ID NO: 4180 - DNA, 48 bp, Artificial Sequence
  Synthetic polynucleotide
cgtaggctagagcggttcatgtgggatcctaaagtttctggtagacct

SEQ ID NO: 4181 - DNA, 48 bp, Artificial Sequence
  Synthetic polynucleotide
ttatgttctaacctgcttaagagcctcgcttcactgaggcgagttaac

SEQ ID NO: 4182 - DNA, 48 bp, Artificial Sequence
  Synthetic polynucleotide
atcacctcaaacgtcattgagtcggtggataatttagtttgcgtcgaa

SEQ ID NO: 4183 - DNA, 48 bp, Artificial Sequence
  Synthetic polynucleotide
cgattggtttttatagggccactgccgccacaaacttctttttttttt

SEQ ID NO: 4184 - DNA, 48 bp, Artificial Sequence
  Synthetic polynucleotide
cgcgaaggaggagcaggaccgcttcttctgtcaagacagttttttttt

SEQ ID NO: 4185 - DNA, 48 bp, Artificial Sequence
  Synthetic polynucleotide
cagactcttaaccctgttttgaaagattctaaatggagcttttttttt

SEQ ID NO: 4186 - DNA, 32 bp, Artificial Sequence; identical to SEQ ID NO: 1984
  Synthetic polynucleotide

SEQ ID NO: 4187 - DNA, 32 bp, Artificial Sequence; identical to SEQ ID NO: 2040
  Synthetic polynucleotide

SEQ ID NO: 4188 - DNA, 32 bp, Artificial Sequence; identical to SEQ ID NO: 3560
  Synthetic polynucleotide

SEQ ID NO: 4189 - DNA, 32 bp, Artificial Sequence
  Synthetic polynucleotide
agactcgactagcacggagtttcgagcttgcg

SEQ ID NO: 4190 - DNA, 32 bp, Artificial Sequence
  Synthetic polynucleotide
aagaagtttgtggcggcgacctcactatcact

SEQ ID NO: 4191 - DNA, 32 bp, Artificial Sequence
  Synthetic polynucleotide
agctccatttagaatcgccatactgttgctcg

SEQ ID NO: 4192 - DNA, 32 bp, Artificial Sequence
  Synthetic polynucleotide
tttttttttgtcgaaaggaggcggtttttttt

SEQ ID NO: 4193 - DNA, 32 bp, Artificial Sequence
  Synthetic polynucleotide
ttttttttctaggtgggtccaacatttttttt

SEQ ID NO: 4194 - DNA, 32 bp, Artificial Sequence
  Synthetic polynucleotide
ttttttttttacgagtaacagcattttttttt

SEQ ID NO: 4195 - DNA, 32 bp, Artificial Sequence
  Synthetic polynucleotide
ttttttttaggcctcgtggtcggttttttttt

SEQ ID NO: 4196 - DNA, 32 bp, Artificial Sequence
  Synthetic polynucleotide
ttttttttcccggtcacgttactgtttttttt

SEQ ID NO: 4197 - DNA, 32 bp, Artificial Sequence
  Synthetic polynucleotide
ttttttttttgctagggatgctattttttttt

SEQ ID NO: 4198 - DNA, 32 bp, Artificial Sequence
  Synthetic polynucleotide
tttttttttatcaggagatgatactttttttt

SEQ ID NO: 4199 - DNA, 32 bp, Artificial Sequence
  Synthetic polynucleotide
ttttttttcagaattacgccgtgttttttttt

SEQ ID NO: 4200 - DNA, 32 bp, Artificial Sequence
  Synthetic polynucleotide
ttttttttcgcaagctcttggacatttttttt

SEQ ID NO: 4201 - DNA, 32 bp, Artificial Sequence
  Synthetic polynucleotide
ttttttttatcatctctcgagtcttttttttt

SEQ ID NO: 4202 - DNA, 32 bp, Artificial Sequence
  Synthetic polynucleotide
ttttttttttgtcgggagttggtctttttttt

SEQ ID NO: 4203 - DNA, 32 bp, Artificial Sequence
  Synthetic polynucleotide
tttttttttttgtgtacccacgtttttttttt

SEQ ID NO: 4204 - DNA, 32 bp, Artificial Sequence
  Synthetic polynucleotide
ttttttttagtgatagggttgagttttttttt

SEQ ID NO: 4205 - DNA, 32 bp, Artificial Sequence
  Synthetic polynucleotide
ttttttttcaatggctgcttaacttttttttt

SEQ ID NO: 4206 - DNA, 32 bp, Artificial Sequence
  Synthetic polynucleotide
ttttttttcgagcaactagggtcatttttttt

SEQ ID NO: 4207 - DNA, 48 bp, Artificial Sequence
  Synthetic polynucleotide
ttttttttgagccacttaacctggcgctcagcccaccttatagcgcct

SEQ ID NO: 4208 - DNA, 48 bp, Artificial Sequence
  Synthetic polynucleotide
ttttttttgttccggttcagaaacaggtagagagtaattgtcgctttt

SEQ ID NO: 4209 - DNA, 48 bp, Artificial Sequence
  Synthetic polynucleotide
ttttttttttctggtcgttatttcacgactttacttacgtgtagtgtc

SEQ ID NO: 4210 - DNA, 48 bp, Artificial Sequence
  Synthetic polynucleotide
agtgacaaaactccggcgcagaagcctaaagatgcatcactttttttt

SEQ ID NO: 4211 - DNA, 48 bp, Artificial Sequence
  Synthetic polynucleotide
gccgttcttccacgaatcgaccgaccatacagcaaactcgtttttttt

SEQ ID NO: 4212 - DNA, 48 bp, Artificial Sequence
  Synthetic polynucleotide
taccctacggggacaacgaagctgttctcatttggtatcgtttttttt

SEQ ID NO: 4213 - DNA, 32 bp, Artificial Sequence; identical to SEQ ID NO: 1986
  Synthetic polynucleotide

SEQ ID NO: 4214 - DNA, 32 bp, Artificial Sequence; identical to SEQ ID NO: 3571
  Synthetic polynucleotide

SEQ ID NO: 4215 - DNA, 32 bp, Artificial Sequence; identical to SEQ ID NO: 3224
  Synthetic polynucleotide

SEQ ID NO: 4216 - DNA, 32 bp, Artificial Sequence
  Synthetic polynucleotide
gtagcaaaagagaggtaggatcacagggttca

SEQ ID NO: 4217 - DNA, 32 bp, Artificial Sequence
  Synthetic polynucleotide
gtgatgcatctttaggcacccgtatgtaaaat

SEQ ID NO: 4218 - DNA, 32 bp, Artificial Sequence
  Synthetic polynucleotide
cgataccaaatgagaaaagccaatcatgccat

SEQ ID NO: 4219 - DNA, 32 bp, Artificial Sequence
  Synthetic polynucleotide
ttttttttgctgaggatttttgtctttttttt

SEQ ID NO: 4220 - DNA, 32 bp, Artificial Sequence
  Synthetic polynucleotide
ttttttttcctcaagcctaacgattttttttt

SEQ ID NO: 4221 - DNA, 32 bp, Artificial Sequence
  Synthetic polynucleotide
ttttttttccggcgaagcatcagatttttttt

SEQ ID NO: 4222 - DNA, 32 bp, Artificial Sequence
  Synthetic polynucleotide
ttttttttttagggtctcgtattatttttttt

SEQ ID NO: 4223 - DNA, 32 bp, Artificial Sequence
  Synthetic polynucleotide
tttttttttgccatcggatgaacatttttttt

SEQ ID NO: 4224 - DNA, 32 bp, Artificial Sequence
  Synthetic polynucleotide
ttttttttttaggtaaagcacgtatttttttt

SEQ ID NO: 4225 - DNA, 32 bp, Artificial Sequence
  Synthetic polynucleotide
ttttttttagaaaacccttggctttttttttt

SEQ ID NO: 4226 - DNA, 32 bp, Artificial Sequence
  Synthetic polynucleotide
ttttttttagcagtacatgaatcctttttttt

SEQ ID NO: 4227 - DNA, 32 bp, Artificial Sequence
  Synthetic polynucleotide
tttttttttgaaccctttaaccattttttttt

SEQ ID NO: 4228 - DNA, 32 bp, Artificial Sequence
  Synthetic polynucleotide
ttttttttcccagcggtttgctactttttttt

SEQ ID NO: 4229 - DNA, 32 bp, Artificial Sequence
  Synthetic polynucleotide
ttttttttgtgagacgttgcgctgtttttttt

SEQ ID NO: 4230 - DNA, 32 bp, Artificial Sequence
  Synthetic polynucleotide
ttttttttagccgatgaatacccatttttttt

SEQ ID NO: 4231 - DNA, 32 bp, Artificial Sequence
  Synthetic polynucleotide
ttttttttattttacaacgtttaatttttttt

SEQ ID NO: 4232 - DNA, 32 bp, Artificial Sequence
  Synthetic polynucleotide
ttttttttttgaaatccgactgggtttttttt

SEQ ID NO: 4233 - DNA, 32 bp, Artificial Sequence
  Synthetic polynucleotide
ttttttttatggcatgtatgacgatttttttt

SEQ ID NO: 4234 - DNA, 48 bp, Artificial Sequence
  Synthetic polynucleotide
ttttttttaaccgtgagtatgattcagtctctgatatcgcttgtcgtt

SEQ ID NO: 4235 - DNA, 48 bp, Artificial Sequence
  Synthetic polynucleotide
ttttttttacagctaagtggctggtatttcgaaggaggtggggtgacc

SEQ ID NO: 4236 - DNA, 48 bp, Artificial Sequence
  Synthetic polynucleotide
ttttttttgcctgtttcggaacaggggtataggcagtccgatgttggg

SEQ ID NO: 4237 - DNA, 48 bp, Artificial Sequence
  Synthetic polynucleotide
ggcgtttgattagattatggtaggggagacagcttaacgatttttttt

SEQ ID NO: 4238 - DNA, 48 bp, Artificial Sequence
  Synthetic polynucleotide
agttgcaagagacctgagcgcgcgatatgacagtcataattttttttt

SEQ ID NO: 4239 - DNA, 48 bp, Artificial Sequence
  Synthetic polynucleotide
tcaccctaacgggttgttcactgattacggcacgggccgttttttttt

SEQ ID NO: 4240 - DNA, 32 bp, Artificial Sequence; identical to SEQ ID NO: 440
  Synthetic polynucleotide

SEQ ID NO: 4241 - DNA, 32 bp, Artificial Sequence
  Synthetic polynucleotide
cattaggtctattataatgggacgccactacg

SEQ ID NO: 4242 - DNA, 32 bp, Artificial Sequence; identical to SEQ ID NO: 3630
  Synthetic polynucleotide

SEQ ID NO: 4243 - DNA, 32 bp, Artificial Sequence
  Synthetic polynucleotide
gtcagtcgatgaagccatgaatgtacccgtca

SEQ ID NO: 4244 - DNA, 32 bp, Artificial Sequence
  Synthetic polynucleotide
tcgttaagctgtctcccggctggacactccaa

SEQ ID NO: 4245 - DNA, 32 bp, Artificial Sequence
  Synthetic polynucleotide
acggcccgtgccgtaagtgaattttgcgccca

SEQ ID NO: 4246 - DNA, 32 bp, Artificial Sequence
  Synthetic polynucleotide
ttttttttgacttgatgccactactttttttt

SEQ ID NO: 4247 - DNA, 32 bp, Artificial Sequence
  Synthetic polynucleotide
ttttttttaaagtattcctctccctttttttt

SEQ ID NO: 4248 - DNA, 32 bp, Artificial Sequence
  Synthetic polynucleotide
ttttttttcgtagtggtagctccgtttttttt

SEQ ID NO: 4249 - DNA, 32 bp, Artificial Sequence
  Synthetic polynucleotide
ttttttttccggcggaacctaatgtttttttt

SEQ ID NO: 4250 - DNA, 32 bp, Artificial Sequence
  Synthetic polynucleotide
ttttttttcatcgtgctactggagtttttttt

SEQ ID NO: 4251 - DNA, 32 bp, Artificial Sequence
  Synthetic polynucleotide
ttttttttggagcgtaaaaccgtttttttttt

SEQ ID NO: 4252 - DNA, 32 bp, Artificial Sequence
  Synthetic polynucleotide
ttttttttctataacggaagttcatttttttt

SEQ ID NO: 4253 - DNA, 32 bp, Artificial Sequence
  Synthetic polynucleotide
ttttttttagcgctatcacttgactttttttt

SEQ ID NO: 4254 - DNA, 32 bp, Artificial Sequence
  Synthetic polynucleotide
tttttttttgacgggtgttagtggtttttttt

SEQ ID NO: 4255 - DNA, 32 bp, Artificial Sequence
  Synthetic polynucleotide
ttttttttctaatacgcgactgactttttttt

SEQ ID NO: 4256 - DNA, 32 bp, Artificial Sequence; identical to SEQ ID NO: 3245
  Synthetic polynucleotide

SEQ ID NO: 4257 - DNA, 32 bp, Artificial Sequence
  Synthetic polynucleotide
ttttttttcaacgctcaaacgcgttttttttt

SEQ ID NO: 4258 - DNA, 32 bp, Artificial Sequence
  Synthetic polynucleotide
ttttttttttggagtgtacaggattttttttt

SEQ ID NO: 4259 - DNA, 32 bp, Artificial Sequence
  Synthetic polynucleotide
ttttttttactagacaacctcgcctttttttt

SEQ ID NO: 4260 - DNA, 32 bp, Artificial Sequence
  Synthetic polynucleotide
tttttttttgggcgcataacctgctttttttt

SEQ ID NO: 4261 - DNA, 48 bp, Artificial Sequence
  Synthetic polynucleotide
ttttttttccatccctaagtaaacccattatagtaatggttataatag

SEQ ID NO: 4262 - DNA, 48 bp, Artificial Sequence
  Synthetic polynucleotide
ttttttttgtgggacgtatgattgcttgcctcagtgtctcaatggcaa

SEQ ID NO: 4263 - DNA, 48 bp, Artificial Sequence
  Synthetic polynucleotide
ttttttttcccgagccaggtggccagtggagctatcctttggtccggg

SEQ ID NO: 4264 - DNA, 48 bp, Artificial Sequence
  Synthetic polynucleotide
tagcgcacttcgacgcccagcatcgagacagacacactgctttttttt

SEQ ID NO: 4265 - DNA, 48 bp, Artificial Sequence
  Synthetic polynucleotide
ggcttgcataaaccggtacagtcattgcaggccctggttgtttttttt

SEQ ID NO: 4266 - DNA, 48 bp, Artificial Sequence
  Synthetic polynucleotide
gtaggagtcttacctaactacactatatgagcgtcccagctttttttt

SEQ ID NO: 4267 - DNA, 32 bp, Artificial Sequence; identical to SEQ ID NO: 988
  Synthetic polynucleotide

SEQ ID NO: 4268 - DNA, 32 bp, Artificial Sequence; identical to SEQ ID NO: 1040
  Synthetic polynucleotide

SEQ ID NO: 4269 - DNA, 32 bp, Artificial Sequence; identical to SEQ ID NO: 1274
  Synthetic polynucleotide

SEQ ID NO: 4270 - DNA, 32 bp, Artificial Sequence; identical to SEQ ID NO: 1326
  Synthetic polynucleotide

SEQ ID NO: 4271 - DNA, 32 bp, Artificial Sequence
  Synthetic polynucleotide
gcagtgtgtctgtctcccataagacgaaccac

SEQ ID NO: 4272 - DNA, 32 bp, Artificial Sequence
  Synthetic polynucleotide
gctgggacgctcatatagcccgatccgaggct

SEQ ID NO: 4273 - DNA, 32 bp, Artificial Sequence
  Synthetic polynucleotide
ttttttttgctgccatagcctacgtttttttt

SEQ ID NO: 4274 - DNA, 32 bp, Artificial Sequence
  Synthetic polynucleotide
ttttttttcacaggatgagtgcaatttttttt

SEQ ID NO: 4275 - DNA, 32 bp, Artificial Sequence
  Synthetic polynucleotide
ttttttttcctgcttcgcgggccgtttttttt

SEQ ID NO: 4276 - DNA, 32 bp, Artificial Sequence
  Synthetic polynucleotide
tttttttttataaaaaaggatggctttttttt

SEQ ID NO: 4277 - DNA, 32 bp, Artificial Sequence
  Synthetic polynucleotide
ttttttttcccgttccggtagaagtttttttt

SEQ ID NO: 4278 - DNA, 32 bp, Artificial Sequence
  Synthetic polynucleotide
ttttttttggggatgatacgagcttttttttt

SEQ ID NO: 4279 - DNA, 32 bp, Artificial Sequence
  Synthetic polynucleotide
ttttttttgctgagaggaacataatttttttt

SEQ ID NO: 4280 - DNA, 32 bp, Artificial Sequence
  Synthetic polynucleotide
ttttttttgtcactgctgagtctatttttttt

SEQ ID NO: 4281 - DNA, 32 bp, Artificial Sequence
  Synthetic polynucleotide
ttttttttgaactagtgaagaggttttttttt

SEQ ID NO: 4282 - DNA, 32 bp, Artificial Sequence
  Synthetic polynucleotide
ttttttttggcgggcaaaatcttctttttttt

SEQ ID NO: 4283 - DNA, 32 bp, Artificial Sequence
  Synthetic polynucleotide
ttttttttcaggtgagaactgcgctttttttt

SEQ ID NO: 4284 - DNA, 32 bp, Artificial Sequence
  Synthetic polynucleotide
ttttttttaataccttttatgtcgtttttttt

SEQ ID NO: 4285 - DNA, 32 bp, Artificial Sequence
  Synthetic polynucleotide
ttttttttgtggttcggaggtgattttttttt

SEQ ID NO: 4286 - DNA, 32 bp, Artificial Sequence
  Synthetic polynucleotide
ttttttttgcacggaataggaatgtttttttt

SEQ ID NO: 4287 - DNA, 32 bp, Artificial Sequence
  Synthetic polynucleotide
ttttttttagcctcggactacttatttttttt

SEQ ID NO: 4288 - DNA, 48 bp, Artificial Sequence
  Synthetic polynucleotide
tttttttttccggtttagcgaattaggatatggctgatgcaagcgggt

SEQ ID NO: 4289 - DNA, 48 bp, Artificial Sequence
  Synthetic polynucleotide
ttttttttgaagcgtaatcgactaagaaactgattactggcattaaga

SEQ ID NO: 4290 - DNA, 48 bp, Artificial Sequence
  Synthetic polynucleotide
ttttttttagtgcgtaagtatagtaggtctactcctcggtagggtgta

SEQ ID NO: 4291 - DNA, 16 bp, Artificial Sequence
  Synthetic polynucleotide
cactgagttttttttt

SEQ ID NO: 4292 - DNA, 16 bp, Artificial Sequence
  Synthetic polynucleotide
agcttgggtttttttt

SEQ ID NO: 4293 - DNA, 16 bp, Artificial Sequence
  Synthetic polynucleotide
gaacttgatttttttt

SEQ ID NO: 4294 - DNA, 16 bp, Artificial Sequence
  Synthetic polynucleotide
ttttttttaggtacct

SEQ ID NO: 4295 - DNA, 16 bp, Artificial Sequence
  Synthetic polynucleotide
ttttttttccggtgag

SEQ ID NO: 4296 - DNA, 16 bp, Artificial Sequence
  Synthetic polynucleotide
ttttttttttgatccg

SEQ ID NO: 4297 - DNA, 32 bp, Artificial Sequence
  Synthetic polynucleotide
cggggaggttttttttttttttttatgtaccg

SEQ ID NO: 4298 - DNA, 32 bp, Artificial Sequence
  Synthetic polynucleotide
gaggtggtttttttttttttttttggaagttc

SEQ ID NO: 4299 - DNA, 32 bp, Artificial Sequence
  Synthetic polynucleotide
caacatttttttttttttttttttacaacata

SEQ ID NO: 4300 - DNA, 32 bp, Artificial Sequence
  Synthetic polynucleotide
ttatattatttttttttttttttttgacggag

SEQ ID NO: 4301 - DNA, 32 bp, Artificial Sequence
  Synthetic polynucleotide
cgaccattttttttttttttttttttgccacc

SEQ ID NO: 4302 - DNA, 32 bp, Artificial Sequence
  Synthetic polynucleotide
tgggagaatttttttttttttttttcaccgaa

SEQ ID NO: 4303 - DNA, 32 bp, Artificial Sequence
  Synthetic polynucleotide
ctggtctcttttttttttttttttgcccacca

SEQ ID NO: 4304 - DNA, 32 bp, Artificial Sequence
  Synthetic polynucleotide
gcgccagatttttttttttttttttatcaaag

SEQ ID NO: 4305 - DNA, 32 bp, Artificial Sequence
  Synthetic polynucleotide
cgatgcggttttttttttttttttagccattt

SEQ ID NO: 4306 - DNA, 32 bp, Artificial Sequence
  Synthetic polynucleotide
cagtatttttttttttttttttttttgcgggg

SEQ ID NO: 4307 - DNA, 32 bp, Artificial Sequence
  Synthetic polynucleotide
tcacgaggttttttttttttttttaaagtgag

SEQ ID NO: 4308 - DNA, 32 bp, Artificial Sequence
  Synthetic polynucleotide
ggcaggcattttttttttttttttgcgcccac

SEQ ID NO: 4309 - DNA, 32 bp, Artificial Sequence
  Synthetic polynucleotide
gaggcagcttttttttttttttttccatttca

SEQ ID NO: 4310 - DNA, 32 bp, Artificial Sequence
  Synthetic polynucleotide
cgagttgattttttttttttttttacaaatta

SEQ ID NO: 4311 - DNA, 32 bp, Artificial Sequence
  Synthetic polynucleotide
tctataacttttttttttttttttttttctta

SEQ ID NO: 4312 - DNA, 32 bp, Artificial Sequence
  Synthetic polynucleotide
atcccttgttttttttttttttttaatcttgg

SEQ ID NO: 4313 - DNA, 32 bp, Artificial Sequence
  Synthetic polynucleotide
ccatatcatttttttttttttttttagtgttg

SEQ ID NO: 4314 - DNA, 32 bp, Artificial Sequence
  Synthetic polynucleotide
cacggcttttttttttttttttttagaagatt

SEQ ID NO: 4315 - DNA, 32 bp, Artificial Sequence
  Synthetic polynucleotide
gttcaacattttttttttttttttattcctga

SEQ ID NO: 4316 - DNA, 32 bp, Artificial Sequence
  Synthetic polynucleotide
cgtggatctttttttttttttttttagagacc

SEQ ID NO: 4317 - DNA, 32 bp, Artificial Sequence
  Synthetic polynucleotide
aggcccacttttttttttttttttgtaatctc

SEQ ID NO: 4318 - DNA, 48 bp, Artificial Sequence
  Synthetic polynucleotide
cgaccatgttttttttttttttttgagatgcggatactttgaaaaggc

SEQ ID NO: 4319 - DNA, 48 bp, Artificial Sequence
  Synthetic polynucleotide
cacttgagttttttttttttttttctgacagacatcttttggggtcgt

SEQ ID NO: 4320 - DNA, 48 bp, Artificial Sequence
  Synthetic polynucleotide
gggcactcttttttttttttttttctgctctaagctgttctccccgtc

SEQ ID NO: 4321 - DNA, 16 bp, Artificial Sequence
  Synthetic polynucleotide
gagtgccccctcggca

SEQ ID NO: 4322 - DNA, 16 bp, Artificial Sequence
  Synthetic polynucleotide
gatatccacggtacat

SEQ ID NO: 4323 - DNA, 16 bp, Artificial Sequence
  Synthetic polynucleotide
taatataatgtccgcg

SEQ ID NO: 4324 - DNA, 16 bp, Artificial Sequence
  Synthetic polynucleotide
atgtgtaatggtgggc

SEQ ID NO: 4325 - DNA, 16 bp, Artificial Sequence
  Synthetic polynucleotide
aaatactgcccacggt

SEQ ID NO: 4326 - DNA, 16 bp, Artificial Sequence
  Synthetic polynucleotide
gcgtatgctgaaatgg

SEQ ID NO: 4327 - DNA, 16 bp, Artificial Sequence
  Synthetic polynucleotide
caagggatatcggctc

SEQ ID NO: 4328 - DNA, 16 bp, Artificial Sequence
  Synthetic polynucleotide
ggcaagagtcaggaat

SEQ ID NO: 4329 - DNA, 16 bp, Artificial Sequence
  Synthetic polynucleotide
tagccgacctctgatg

SEQ ID NO: 4330 - DNA, 16 bp, Artificial Sequence
  Synthetic polynucleotide
tagccctacggatcaa

SEQ ID NO: 4331 - DNA, 32 bp, Artificial Sequence; identical to SEQ ID NO: 24
  Synthetic polynucleotide

SEQ ID NO: 4332 - DNA, 32 bp, Artificial Sequence; identical to SEQ ID NO: 62
  Synthetic polynucleotide

SEQ ID NO: 4333 - DNA, 32 bp, Artificial Sequence; identical to SEQ ID NO: 158
  Synthetic polynucleotide

SEQ ID NO: 4334 - DNA, 32 bp, Artificial Sequence; identical to SEQ ID NO: 442
  Synthetic polynucleotide

SEQ ID NO: 4335 - DNA, 32 bp, Artificial Sequence; identical to SEQ ID NO: 2022
  Synthetic polynucleotide

SEQ ID NO: 4336 - DNA, 32 bp, Artificial Sequence; identical to SEQ ID NO: 3499
  Synthetic polynucleotide

SEQ ID NO: 4337 - DNA, 32 bp, Artificial Sequence
  Synthetic polynucleotide
tgtgtatgctcacttttctggcgccggcttag

SEQ ID NO: 4338 - DNA, 32 bp, Artificial Sequence; identical to SEQ ID NO: 4087
  Synthetic polynucleotide

SEQ ID NO: 4339 - DNA, 32 bp, Artificial Sequence
  Synthetic polynucleotide
cggcgatttaatttgttgcctgccggtgtgag

SEQ ID NO: 4340 - DNA, 32 bp, Artificial Sequence; identical to SEQ ID NO: 4088
  Synthetic polynucleotide

SEQ ID NO: 4341 - DNA, 32 bp, Artificial Sequence; identical to SEQ ID NO: 4089
  Synthetic polynucleotide

SEQ ID NO: 4342 - DNA, 32 bp, Artificial Sequence
  Synthetic polynucleotide
ttcatactggtctctaaagccgtgagaggacc

SEQ ID NO: 4343 - DNA, 32 bp, Artificial Sequence; identical to SEQ ID NO: 3308
  Synthetic polynucleotide

SEQ ID NO: 4344 - DNA, 32 bp, Artificial Sequence; identical to SEQ ID NO: 4090
  Synthetic polynucleotide

SEQ ID NO: 4345 - DNA, 32 bp, Artificial Sequence
  Synthetic polynucleotide
aacgaattctcaccggtggataaaaacttcta

SEQ ID NO: 4346 - DNA, 48 bp, Artificial Sequence
  Synthetic polynucleotide
aaagtatccgcatctcactcagtgatcgagtaccaggttaagtggctc

SEQ ID NO: 4347 - DNA, 48 bp, Artificial Sequence
  Synthetic polynucleotide
ttcaagtattcggtgacctccccgcattacaatttcatggcggcgatg

SEQ ID NO: 4348 - DNA, 48 bp, Artificial Sequence
  Synthetic polynucleotide
actgctgggtgggcgcgagaccaggcgtccggtacggcaccgaggcct

SEQ ID NO: 4349 - DNA, 48 bp, Artificial Sequence
  Synthetic polynucleotide
agcttcgcaatcttctgctgcctctaggggggaccaatgtaagcagat

SEQ ID NO: 4350 - DNA, 48 bp, Artificial Sequence
  Synthetic polynucleotide
tcagagttcccaccactgttgaacgttgctaaagagtctggagatgat

SEQ ID NO: 4351 - DNA, 32 bp, Artificial Sequence
  Synthetic polynucleotide
cgtgcacatgccgaggaagcctgatacactaa

SEQ ID NO: 4352 - DNA, 32 bp, Artificial Sequence
  Synthetic polynucleotide
tagtttgaactgttagtgtcgtataatgggta

SEQ ID NO: 4353 - DNA, 32 bp, Artificial Sequence
  Synthetic polynucleotide
actctcgtcagtagaatacttgaattacttgg

SEQ ID NO: 4354 - DNA, 32 bp, Artificial Sequence
  Synthetic polynucleotide
ccatgaaattgtaatgttacacatggcgcaga

SEQ ID NO: 4355 - DNA, 32 bp, Artificial Sequence
  Synthetic polynucleotide
tacatacgtgacatcgatcatgagttttttgt

SEQ ID NO: 4356 - DNA, 32 bp, Artificial Sequence
  Synthetic polynucleotide
tcacagtgatctcagcctctccgccggcgaaa

SEQ ID NO: 4357 - DNA, 32 bp, Artificial Sequence
  Synthetic polynucleotide
atcgctcacgcggacaccacggaaggtatgct

SEQ ID NO: 4358 - DNA, 32 bp, Artificial Sequence
  Synthetic polynucleotide
taggcaagcatattgtcatacacaccacaatg

SEQ ID NO: 4359 - DNA, 32 bp, Artificial Sequence
  Synthetic polynucleotide
gtggcgcttatccattccagcagtaaacgtcc

SEQ ID NO: 4360 - DNA, 32 bp, Artificial Sequence
  Synthetic polynucleotide
gtgccgtaccggacgcgcatacgcaaaacgta

SEQ ID NO: 4361 - DNA, 32 bp, Artificial Sequence
  Synthetic polynucleotide
tattgctcctaagccgaatcgccgaactctaa

SEQ ID NO: 4362 - DNA, 32 bp, Artificial Sequence
  Synthetic polynucleotide
gcggcgaacccctcaggctctggagcgaccga

SEQ ID NO: 4363 - DNA, 32 bp, Artificial Sequence
  Synthetic polynucleotide
tgcataccaccgtgggtttcaccgtctcgata

SEQ ID NO: 4364 - DNA, 32 bp, Artificial Sequence
  Synthetic polynucleotide
aggcagtcctctgatattaagagccgggcgac

SEQ ID NO: 4365 - DNA, 32 bp, Artificial Sequence
  Synthetic polynucleotide
cgcattacctcacaccgcgaagcttacaggca

SEQ ID NO: 4366 - DNA, 32 bp, Artificial Sequence
  Synthetic polynucleotide
acattggtcccccctactcttgccgaggagga

SEQ ID NO: 4367 - DNA, 32 bp, Artificial Sequence
  Synthetic polynucleotide
gactattgagtgtgtaagtatgaaagtatcca

SEQ ID NO: 4368 - DNA, 32 bp, Artificial Sequence
  Synthetic polynucleotide
acttgatttgtattcttcaggatcgtgtttcc

SEQ ID NO: 4369 - DNA, 32 bp, Artificial Sequence
  Synthetic polynucleotide
cgggcccagagccgattgactgtgatcgcgga

SEQ ID NO: 4370 - DNA, 32 bp, Artificial Sequence
  Synthetic polynucleotide
ggccgaaaattttggagctggacgtgcgcgag

SEQ ID NO: 4371 - DNA, 32 bp, Artificial Sequence
  Synthetic polynucleotide
caatcaggggtcctctaactctgagcgaagtt

SEQ ID NO: 4372 - DNA, 48 bp, Artificial Sequence
  Synthetic polynucleotide
ccgtcctccatcagaggtcggctattttttttttttttttctaccgat

SEQ ID NO: 4373 - DNA, 48 bp, Artificial Sequence
  Synthetic polynucleotide
agggggacaataaatggtccaggcttttttttttttttttacagatgc

SEQ ID NO: 4374 - DNA, 48 bp, Artificial Sequence
  Synthetic polynucleotide
aatcgtgatagaagtttttatccattttttttttttttttgtggtggg

SEQ ID NO: 4375 - DNA, 32 bp, Artificial Sequence; identical to SEQ ID NO: 7
  Synthetic polynucleotide

SEQ ID NO: 4376 - DNA, 32 bp, Artificial Sequence; identical to SEQ ID NO: 3319
  Synthetic polynucleotide

SEQ ID NO: 4377 - DNA, 32 bp, Artificial Sequence
  Synthetic polynucleotide
tcgtatgatcataggatcaaactaaatacagc

SEQ ID NO: 4378 - DNA, 32 bp, Artificial Sequence; identical to SEQ ID NO: 429
  Synthetic polynucleotide

SEQ ID NO: 4379 - DNA, 32 bp, Artificial Sequence
  Synthetic polynucleotide
gcgccgcatacccattcactgtgaatttccac

SEQ ID NO: 4380 - DNA, 32 bp, Artificial Sequence
  Synthetic polynucleotide
gggcgtaaacaaaaaacttgcctatcgtgccc

SEQ ID NO: 4381 - DNA, 32 bp, Artificial Sequence
  Synthetic polynucleotide
cactgtgtggacgtttgagcaatagaaattga

SEQ ID NO: 4382 - DNA, 32 bp, Artificial Sequence; identical to SEQ ID NO: 3664
  Synthetic polynucleotide

SEQ ID NO: 4383 - DNA, 32 bp, Artificial Sequence
  Synthetic polynucleotide
cgtgggtcttagagttgactgcctcattaata

SEQ ID NO: 4384 - DNA, 32 bp, Artificial Sequence; identical to SEQ ID NO: 3215
  Synthetic polynucleotide

SEQ ID NO: 4385 - DNA, 32 bp, Artificial Sequence; identical to SEQ ID NO: 1272
  Synthetic polynucleotide

SEQ ID NO: 4386 - DNA, 32 bp, Artificial Sequence
  Synthetic polynucleotide
gtatgttttggatacttttcggcctcagcggg

SEQ ID NO: 4387 - DNA, 32 bp, Artificial Sequence
  Synthetic polynucleotide
ggcacttgaacttcgcgacatattcaaatgag

SEQ ID NO: 4388 - DNA, 32 bp, Artificial Sequence; identical to SEQ ID NO: 4120
  Synthetic polynucleotide

SEQ ID NO: 4389 - DNA, 32 bp, Artificial Sequence
  Synthetic polynucleotide
taattgcaatctgcaagtccccctacttactg

SEQ ID NO: 4390 - DNA, 48 bp, Artificial Sequence
  Synthetic polynucleotide
tacctatggacggggagaacagcttagagcagtcaagttcggatacgc

SEQ ID NO: 4391 - DNA, 48 bp, Artificial Sequence
  Synthetic polynucleotide
tgattggtttagtgtatcaggcttctccgtcaaaatgttggctgagat

SEQ ID NO: 4392 - DNA, 48 bp, Artificial Sequence; identical to SEQ ID NO: 3112
  Synthetic polynucleotide

SEQ ID NO: 4393 - DNA, 48 bp, Artificial Sequence
  Synthetic polynucleotide
cattccaatatcgagacggtgaaaccaagattgttatagaagaataca

SEQ ID NO: 4394 - DNA, 48 bp, Artificial Sequence
  Synthetic polynucleotide
tgtccttgtccgcgatcacagtcaatcggtaggtgggccttgaggtta

SEQ ID NO: 4395 - DNA, 48 bp, Artificial Sequence
  Synthetic polynucleotide
ctgagcgttaacctcatttgagtaattcctcaatgaacccgcgtcgtc

SEQ ID NO: 4396 - DNA, 48 bp, Artificial Sequence
  Synthetic polynucleotide
aatatgtcaaatctgaaattcgttttgcagattgcaattaagagtcta

SEQ ID NO: 4397 - DNA, 48 bp, Artificial Sequence
  Synthetic polynucleotide
cagactctttagcaactagggctaacgtaaagaaattgactgtccgtc

SEQ ID NO: 4398 - DNA, 48 bp, Artificial Sequence
  Synthetic polynucleotide
actaattatccataactgtgcacgtcagggatgccgcctcggttatac

SEQ ID NO: 4399 - DNA, 48 bp, Artificial Sequence
  Synthetic polynucleotide
tattaagttttcgccgtgagcgatcaatgaccgatcagcgaattcgac

SEQ ID NO: 4400 - DNA, 48 bp, Artificial Sequence
  Synthetic polynucleotide
gtcgtaactcggtcgcggtatgcattggctcaattaggcactccataa

SEQ ID NO: 4401 - DNA, 48 bp, Artificial Sequence
  Synthetic polynucleotide
gtgcaacgggaaacactgggcccggggtttgtcttcggattctctggc

SEQ ID NO: 4402 - DNA, 48 bp, Artificial Sequence
  Synthetic polynucleotide
gggttcattgaggaatgaggacggtaaccaaatgatgtgagttgttgg

SEQ ID NO: 4403 - DNA, 32 bp, Artificial Sequence
  Synthetic polynucleotide
aattcatccatcgccggtaaacgataggtttc

SEQ ID NO: 4404 - DNA, 32 bp, Artificial Sequence
  Synthetic polynucleotide
cccatggatcgcgtcgtcatacgacaagaact

SEQ ID NO: 4405 - DNA, 32 bp, Artificial Sequence
  Synthetic polynucleotide
ctcccacagtggaaattaattagtacggccac

SEQ ID NO: 4406 - DNA, 32 bp, Artificial Sequence
  Synthetic polynucleotide
cgctgatcggtcattgaccaatcatatctctt

SEQ ID NO: 4407 - DNA, 32 bp, Artificial Sequence
  Synthetic polynucleotide
gcagggtggggcacgatgcggcgccctgcgaa

SEQ ID NO: 4408 - DNA, 32 bp, Artificial Sequence
  Synthetic polynucleotide
taggtggtttggggactaagcgcgcacccgtt

SEQ ID NO: 4409 - DNA, 32 bp, Artificial Sequence
  Synthetic polynucleotide
gagccgataggcctcgtatcgtcctgacaggt

SEQ ID NO: 4410 - DNA, 32 bp, Artificial Sequence
  Synthetic polynucleotide
cgtcctgttcaatttcttacgcccagacaatg

SEQ ID NO: 4411 - DNA, 32 bp, Artificial Sequence
  Synthetic polynucleotide
gatcacccaaaacgacacttaatattcaggct

SEQ ID NO: 4412 - DNA, 32 bp, Artificial Sequence
  Synthetic polynucleotide
tgcctaattgagccaaatcccctcgcgagggt

SEQ ID NO: 4413 - DNA, 32 bp, Artificial Sequence
  Synthetic polynucleotide
cgcgagactattaatgcgtgacggtgaatctt

SEQ ID NO: 4414 - DNA, 32 bp, Artificial Sequence
  Synthetic polynucleotide
tgacactgcctggtttacacagtgtgcagggt

SEQ ID NO: 4415 - DNA, 32 bp, Artificial Sequence
  Synthetic polynucleotide
gtcggcccatctgcttggagggttccttgatg

SEQ ID NO: 4416 - DNA, 32 bp, Artificial Sequence
  Synthetic polynucleotide
acgttgtttcggtcacgacccacgttaatcct

SEQ ID NO: 4417 - DNA, 32 bp, Artificial Sequence
  Synthetic polynucleotide
gccaaggattcgccctgttacgacgaaatact

SEQ ID NO: 4418 - DNA, 32 bp, Artificial Sequence
  Synthetic polynucleotide
atccgaagacaaacccttggaatgtctttgct

SEQ ID NO: 4419 - DNA, 32 bp, Artificial Sequence
  Synthetic polynucleotide
gtgtaagacccgctgatagtgacgcggggcat

SEQ ID NO: 4420 - DNA, 32 bp, Artificial Sequence
  Synthetic polynucleotide
tgaaagaactctatattggacaaattcgcgtg

SEQ ID NO: 4421 - DNA, 32 bp, Artificial Sequence
  Synthetic polynucleotide
ccgttcacatcatctcgacgcttatttacatc

SEQ ID NO: 4422 - DNA, 32 bp, Artificial Sequence
  Synthetic polynucleotide
attcccagctcatttgaaacatacttgcggca

SEQ ID NO: 4423 - DNA, 32 bp, Artificial Sequence
  Synthetic polynucleotide
cccaaatgcagaccggcgttgcacattgtacc

SEQ ID NO: 4424 - DNA, 48 bp, Artificial Sequence
  Synthetic polynucleotide
atttccgcgagccacttaacctggtactcgattggatatctccgtgca

SEQ ID NO: 4425 - DNA, 48 bp, Artificial Sequence
  Synthetic polynucleotide
aataaggaatgccagcgacatgaatactctgaatgaacaccccgctgc

SEQ ID NO: 4426 - DNA, 48 bp, Artificial Sequence
  Synthetic polynucleotide
cgtttgtcaagtgtgtcaccgttcttatgctaagctctgttcctatga

SEQ ID NO: 4427 - DNA, 48 bp, Artificial Sequence
  Synthetic polynucleotide
atgtagcagctgtattccagccgcgcgcagggctcgacggttaatttg

SEQ ID NO: 4428 - DNA, 48 bp, Artificial Sequence
  Synthetic polynucleotide
tcatccggtcagtcgtcgcacggcgcgtatccgtgggtaagttatgga

SEQ ID NO: 4429 - DNA, 48 bp, Artificial Sequence
  Synthetic polynucleotide
gaggcggcatccctgacataggtaatcatggtgtcgcatatatcccaa

SEQ ID NO: 4430 - DNA, 32 bp, Artificial Sequence
  Synthetic polynucleotide
ccgtcgagccctgcgcgacaaacgcatatcct

SEQ ID NO: 4431 - DNA, 32 bp, Artificial Sequence; identical to SEQ ID NO: 64
  Synthetic polynucleotide

SEQ ID NO: 4432 - DNA, 32 bp, Artificial Sequence
  Synthetic polynucleotide
gtaccgccagttcttgtccttattggcgatcg

SEQ ID NO: 4433 - DNA, 32 bp, Artificial Sequence; identical to SEQ ID NO: 4145
  Synthetic polynucleotide

SEQ ID NO: 4434 - DNA, 32 bp, Artificial Sequence; identical to SEQ ID NO: 3331
  Synthetic polynucleotide

SEQ ID NO: 4435 - DNA, 32 bp, Artificial Sequence; identical to SEQ ID NO: 3523
  Synthetic polynucleotide

SEQ ID NO: 4436 - DNA, 32 bp, Artificial Sequence
  Synthetic polynucleotide
ctcagtttaagattcaacaggacgatgttctc

SEQ ID NO: 4437 - DNA, 32 bp, Artificial Sequence; identical to SEQ ID NO: 4147
  Synthetic polynucleotide

SEQ ID NO: 4438 - DNA, 32 bp, Artificial Sequence
  Synthetic polynucleotide
tccgcataaggattaacagtgtcatcggtaca

SEQ ID NO: 4439 - DNA, 32 bp, Artificial Sequence; identical to SEQ ID NO: 4148
  Synthetic polynucleotide

SEQ ID NO: 4440 - DNA, 32 bp, Artificial Sequence; identical to SEQ ID NO: 4149
  Synthetic polynucleotide

SEQ ID NO: 4441 - DNA, 32 bp, Artificial Sequence
  Synthetic polynucleotide
tcactctttgccgcaattctttcaacgggggc

SEQ ID NO: 4442 - DNA, 32 bp, Artificial Sequence; identical to SEQ ID NO: 1356
  Synthetic polynucleotide

SEQ ID NO: 4443 - DNA, 32 bp, Artificial Sequence; identical to SEQ ID NO: 4150
  Synthetic polynucleotide

SEQ ID NO: 4444 - DNA, 32 bp, Artificial Sequence
  Synthetic polynucleotide
aaggagcttagactcttcctaacaagacgctg

SEQ ID NO: 4445 - DNA, 48 bp, Artificial Sequence
  Synthetic polynucleotide
gtgttcattcagagtagcggaaatatggccgcaatcatactcacggtt

SEQ ID NO: 4446 - DNA, 48 bp, Artificial Sequence; identical to SEQ ID NO: 3343
  Synthetic polynucleotide

SEQ ID NO: 4447 - DNA, 48 bp, Artificial Sequence
  Synthetic polynucleotide
tgcgagtgaacgggtggatgaatttcgttcggtcgccgtttgctcgcg

SEQ ID NO: 4448 - DNA, 48 bp, Artificial Sequence
  Synthetic polynucleotide
ttgtcgggacctgtcaggacgatatctgcgccagcgccacgtccccaa

SEQ ID NO: 4449 - DNA, 48 bp, Artificial Sequence
  Synthetic polynucleotide
tatgagttaccctgcaatcggctcaagacgtaaatccgatgaccctaa

SEQ ID NO: 4450 - DNA, 48 bp, Artificial Sequence
  Synthetic polynucleotide
agcctattcatcaaggaaccctcctacgttttgtaatgcgaaaccagg

SEQ ID NO: 4451 - DNA, 48 bp, Artificial Sequence
  Synthetic polynucleotide
gcgctagtcacgcgaagggccgacaatcggcgggatctaccggcatgc

SEQ ID NO: 4452 - DNA, 48 bp, Artificial Sequence
  Synthetic polynucleotide
gtaattaggatgtaaataagcgtctcctcctccctgattgatatagag

SEQ ID NO: 4453 - DNA, 48 bp, Artificial Sequence
  Synthetic polynucleotide
cagcgagcgttttacggtgaacggtgggcattgtagggtaccgctggg

SEQ ID NO: 4454 - DNA, 48 bp, Artificial Sequence
  Synthetic polynucleotide
tttacaaagacggacagtcaatttctttacgttcacgattgtagaaat

SEQ ID NO: 4455 - DNA, 32 bp, Artificial Sequence
  Synthetic polynucleotide
agtatagtgtataaccactcgctagtcaactt

SEQ ID NO: 4456 - DNA, 32 bp, Artificial Sequence
  Synthetic polynucleotide
gcggccatagaaactgtcctcggtagggtgta

SEQ ID NO: 4457 - DNA, 32 bp, Artificial Sequence
  Synthetic polynucleotide
tcgcaacgcgatcgcccactcgcacttagatc

SEQ ID NO: 4458 - DNA, 32 bp, Artificial Sequence
  Synthetic polynucleotide
aacggcgaccgaacgacccgacaattgttcat

SEQ ID NO: 4459 - DNA, 32 bp, Artificial Sequence
  Synthetic polynucleotide
gcgccagatggtgaatctgtatgaatctatgt

SEQ ID NO: 4460 - DNA, 32 bp, Artificial Sequence
  Synthetic polynucleotide
ggagaatctaatgatcattactggcattaaga

SEQ ID NO: 4461 - DNA, 32 bp, Artificial Sequence
  Synthetic polynucleotide
gaattatagtcgaattttgtgctgcacagcac

SEQ ID NO: 4462 - DNA, 32 bp, Artificial Sequence
  Synthetic polynucleotide
gcccgacgccgtcgataaactgagtaagacct

SEQ ID NO: 4463 - DNA, 32 bp, Artificial Sequence
  Synthetic polynucleotide
gacccaggtaagaacaaactcataggtgcgtc

SEQ ID NO: 4464 - DNA, 32 bp, Artificial Sequence
  Synthetic polynucleotide
atcggatttacgtcttaataggctaacgttat

SEQ ID NO: 4465 - DNA, 32 bp, Artificial Sequence
  Synthetic polynucleotide
aattatcagagaacattatgcggaaccggata

SEQ ID NO: 4466 - DNA, 32 bp, Artificial Sequence
  Synthetic polynucleotide
gccaaaattaacggccagacgtttcctcacgc

SEQ ID NO: 4467 - DNA, 32 bp, Artificial Sequence
  Synthetic polynucleotide
ggcccatattatggagtgtgtggaaaactaaa

SEQ ID NO: 4468 - DNA, 32 bp, Artificial Sequence
  Synthetic polynucleotide
cgatgtcgtagcgtctttgcggtaacggctag

SEQ ID NO: 4469 - DNA, 32 bp, Artificial Sequence
  Synthetic polynucleotide
caaatccctgtaccgaactagcgcttccagta

SEQ ID NO: 4470 - DNA, 32 bp, Artificial Sequence
  Synthetic polynucleotide
gtagatcccgccgattctaattacacccccgc

SEQ ID NO: 4471 - DNA, 32 bp, Artificial Sequence
  Synthetic polynucleotide
gcttaacaaatgagacaagagtgacatgtagg

SEQ ID NO: 4472 - DNA, 32 bp, Artificial Sequence
  Synthetic polynucleotide
cctatcacctaactatagtaaacaatcaagga

SEQ ID NO: 4473 - DNA, 32 bp, Artificial Sequence
  Synthetic polynucleotide
cttatcctgccagagacggacgaagagcaagg

SEQ ID NO: 4474 - DNA, 32 bp, Artificial Sequence
  Synthetic polynucleotide
ctttattttcctacccatgctagcgccacacg

SEQ ID NO: 4475 - DNA, 32 bp, Artificial Sequence
  Synthetic polynucleotide
cggcgttagcccccgtgctcgctgcctgatgt

SEQ ID NO: 4476 - DNA, 48 bp, Artificial Sequence
  Synthetic polynucleotide
tagcgcacccaacaactcacatcatttggttacaaggacatagagcac

SEQ ID NO: 4477 - DNA, 48 bp, Artificial Sequence
  Synthetic polynucleotide
gctacgcataaaccgggcatgctgcagtaagtgcacgtatgtcttgag

SEQ ID NO: 4478 - DNA, 48 bp, Artificial Sequence
  Synthetic polynucleotide
tcattccgcagcgtcttgttaggaatttctaccaagtgcccgtaaaac

SEQ ID NO: 4479 - DNA, 32 bp, Artificial Sequence; identical to SEQ ID NO: 9
  Synthetic polynucleotide

SEQ ID NO: 4480 - DNA, 32 bp, Artificial Sequence; identical to SEQ ID NO: 28
  Synthetic polynucleotide

SEQ ID NO: 4481 - DNA, 32 bp, Artificial Sequence; identical to SEQ ID NO: 162
  Synthetic polynucleotide

SEQ ID NO: 4482 - DNA, 32 bp, Artificial Sequence; identical to SEQ ID NO: 430
  Synthetic polynucleotide

SEQ ID NO: 4483 - DNA, 32 bp, Artificial Sequence; identical to SEQ ID NO: 988
  Synthetic polynucleotide

SEQ ID NO: 4484 - DNA, 32 bp, Artificial Sequence
  Synthetic polynucleotide
tgctgttaacatagatcgtcgggcgaccttcg

SEQ ID NO: 4485 - DNA, 32 bp, Artificial Sequence
  Synthetic polynucleotide
gaatgagcgacgcacctgataattaacactcc

SEQ ID NO: 4486 - DNA, 32 bp, Artificial Sequence; identical to SEQ ID NO: 4174
  Synthetic polynucleotide

SEQ ID NO: 4487 - DNA, 32 bp, Artificial Sequence
  Synthetic polynucleotide
gccagggttatccggtcgacatcgaccgttca

SEQ ID NO: 4488 - DNA, 32 bp, Artificial Sequence; identical to SEQ ID NO: 3536
  Synthetic polynucleotide

SEQ ID NO: 4489 - DNA, 32 bp, Artificial Sequence; identical to SEQ ID NO: 1274
  Synthetic polynucleotide

SEQ ID NO: 4490 - DNA, 32 bp, Artificial Sequence
  Synthetic polynucleotide
tcacacttcctacatgaaataaaggtacccgt

SEQ ID NO: 4491 - DNA, 32 bp, Artificial Sequence
  Synthetic polynucleotide
gactacctacatcaggtttgcgtgcctaacca

SEQ ID NO: 4492 - DNA, 32 bp, Artificial Sequence; identical to SEQ ID NO: 3665
  Synthetic polynucleotide

SEQ ID NO: 4493 - DNA, 32 bp, Artificial Sequence
  Synthetic polynucleotide
gtcgcacttgtgtgaatgcgtagcatgcaccg

SEQ ID NO: 4494 - DNA, 48 bp, Artificial Sequence
  Synthetic polynucleotide
gatcgtcattgggatatatgcgacaccatgatccggatgagttatgaa

SEQ ID NO: 4495 - DNA, 48 bp, Artificial Sequence
  Synthetic polynucleotide
caggatcaaagttgactagcgagtaagagatatgtgggaggatcatta

SEQ ID NO: 4496 - DNA, 48 bp, Artificial Sequence; identical to SEQ ID NO: 3124
  Synthetic polynucleotide

SEQ ID NO: 4497 - DNA, 48 bp, Artificial Sequence
  Synthetic polynucleotide
tgactaggtttagttttccacacaagcaaagatccttggcatagttag

SEQ ID NO: 4498 - DNA, 48 bp, Artificial Sequence
  Synthetic polynucleotide
tgcttgctccttgctcttcgtccggtgctctacatttggggcagtgga

SEQ ID NO: 4499 - DNA, 48 bp, Artificial Sequence
  Synthetic polynucleotide
ggcttgcatccactgcagtgcccttatgcctataggaatgaactgcac

SEQ ID NO: 4500 - DNA, 48 bp, Artificial Sequence
  Synthetic polynucleotide
cacgcaaacttacctaagctccttttcacacaagtgcgactttcactg

SEQ ID NO: 4501 - DNA, 48 bp, Artificial Sequence
  Synthetic polynucleotide
taccctacaatgcccatttgtaaacggtttcttttgaagatgtcaggg

SEQ ID NO: 4502 - DNA, 48 bp, Artificial Sequence
  Synthetic polynucleotide
ttgcactcctggggaaactatacttacgcacttcgtcaagcctgcttt

SEQ ID NO: 4503 - DNA, 48 bp, Artificial Sequence
  Synthetic polynucleotide
cttctacctcttaatgtataattcatcctgtgacaatggtatcttttg

SEQ ID NO: 4504 - DNA, 48 bp, Artificial Sequence
  Synthetic polynucleotide
tagactcagcgtgaggtatgggcctcatccccaggcgtctcaggaagt

SEQ ID NO: 4505 - DNA, 48 bp, Artificial Sequence
  Synthetic polynucleotide
gcgcagtttccttgataggataaggcagtgaccttacactttcgggag

SEQ ID NO: 4506 - DNA, 48 bp, Artificial Sequence
  Synthetic polynucleotide
cattcctataggcatagtgcgctaaaggtattgttgtgtctatgaggc

SEQ ID NO: 4507 - DNA, 32 bp, Artificial Sequence
  Synthetic polynucleotide
aaagcttccgcgagcaccccaagtgctacatg

SEQ ID NO: 4508 - DNA, 32 bp, Artificial Sequence
  Synthetic polynucleotide
accagttcgtcctcacggaatgcaacaccggc

SEQ ID NO: 4509 - DNA, 32 bp, Artificial Sequence
  Synthetic polynucleotide
attcggatgctgccatgagtgcaactaatccc

SEQ ID NO: 4510 - DNA, 32 bp, Artificial Sequence
  Synthetic polynucleotide
accattgtcacaggattgatcctggcaaatta

SEQ ID NO: 4511 - DNA, 32 bp, Artificial Sequence
  Synthetic polynucleotide
gccgatggcgaaggtctacgagctagacctgt

SEQ ID NO: 4512 - DNA, 32 bp, Artificial Sequence
  Synthetic polynucleotide
tggtcggtggcagcaggcctggccctacttca

SEQ ID NO: 4513 - DNA, 32 bp, Artificial Sequence
  Synthetic polynucleotide
gcgacgctttagggtccactccaagtgaaccc

SEQ ID NO: 4514 - DNA, 32 bp, Artificial Sequence
  Synthetic polynucleotide
gcggatgcggagtgtttaacagcaggtcggcc

SEQ ID NO: 4515 - DNA, 32 bp, Artificial Sequence
  Synthetic polynucleotide
ttgttgcgcccgttccggtagaaggaactctg

SEQ ID NO: 4516 - DNA, 32 bp, Artificial Sequence
  Synthetic polynucleotide
agacgcctggggatgaattacgacaaggagat

SEQ ID NO: 4517 - DNA, 32 bp, Artificial Sequence
  Synthetic polynucleotide
ctgcgtcatgaacggtgaagaggtcaaggacg

SEQ ID NO: 4518 - DNA, 32 bp, Artificial Sequence
  Synthetic polynucleotide
atggattgaggcggaagctcattcgcctacct

SEQ ID NO: 4519 - DNA, 32 bp, Artificial Sequence
  Synthetic polynucleotide
aagccactgcatgccggatctttcggaccgag

SEQ ID NO: 4520 - DNA, 32 bp, Artificial Sequence
  Synthetic polynucleotide
agggccaattatttacaccctggccgagtgga

SEQ ID NO: 4521 - DNA, 32 bp, Artificial Sequence
  Synthetic polynucleotide
atgcataagctgagagtgagtctacctgtggg

SEQ ID NO: 4522 - DNA, 32 bp, Artificial Sequence
  Synthetic polynucleotide
agtgtaaggtcactgccctagtcagttaacat

SEQ ID NO: 4523 - DNA, 32 bp, Artificial Sequence
  Synthetic polynucleotide
atggttatacgggtacttatgtcgggcctcag

SEQ ID NO: 4524 - DNA, 32 bp, Artificial Sequence
  Synthetic polynucleotide
tcgagtctagctaccgtacaggtgcctttcac

SEQ ID NO: 4525 - DNA, 32 bp, Artificial Sequence
  Synthetic polynucleotide
catattttcccagcggcacaaccccctctacg

SEQ ID NO: 4526 - DNA, 32 bp, Artificial Sequence
  Synthetic polynucleotide
gattctaatggttaggaagtgtgagggtggtc

SEQ ID NO: 4527 - DNA, 32 bp, Artificial Sequence
  Synthetic polynucleotide
gatgaaggcaggtgagaactgcgcagtaccca

SEQ ID NO: 4528 - DNA, 48 bp, Artificial Sequence
  Synthetic polynucleotide
gtattagcaaccgtgagtatgattgcggccattcttgcttatcttagt

SEQ ID NO: 4529 - DNA, 48 bp, Artificial Sequence
  Synthetic polynucleotide
atgtggttgcgaaaatgcaccgaaaaaagcccgggctgatcccgcaac

SEQ ID NO: 4530 - DNA, 48 bp, Artificial Sequence
  Synthetic polynucleotide
attaccgttaagcgttacaggcggaggatatgggcggtaccaaacatt

SEQ ID NO: 4531 - DNA, 48 bp, Artificial Sequence
  Synthetic polynucleotide
gcaattgctaagccacgcgggccgggaaggacctttaggcccaaggag

SEQ ID NO: 4532 - DNA, 48 bp, Artificial Sequence
  Synthetic polynucleotide
gctatgctgaagcgtaatcgactattcataaccggtgagattccccag

SEQ ID NO: 4533 - DNA, 48 bp, Artificial Sequence
  Synthetic polynucleotide
cttgacgaagtgcgtatgacgatcttacttcgagattgtagctgtgac

SEQ ID NO: 4534 - DNA, 32 bp, Artificial Sequence
  Synthetic polynucleotide
gcctaaaggtccttccacggtaatcgggggtg

SEQ ID NO: 4535 - DNA, 32 bp, Artificial Sequence; identical to SEQ ID NO: 66
  Synthetic polynucleotide

SEQ ID NO: 4536 - DNA, 32 bp, Artificial Sequence
  Synthetic polynucleotide
ttaagacggccggtgtaaccacataaagtcgt

SEQ ID NO: 4537 - DNA, 32 bp, Artificial Sequence
  Synthetic polynucleotide
gcttcggtacaggtctgaactggtagatcacc

SEQ ID NO: 4538 - DNA, 32 bp, Artificial Sequence; identical to SEQ ID NO: 3355
  Synthetic polynucleotide

SEQ ID NO: 4539 - DNA, 32 bp, Artificial Sequence; identical to SEQ ID NO: 3547
  Synthetic polynucleotide

SEQ ID NO: 4540 - DNA, 32 bp, Artificial Sequence
  Synthetic polynucleotide
aagcatcgcgtccttggcatccgctcgcatgg

SEQ ID NO: 4541 - DNA, 32 bp, Artificial Sequence
  Synthetic polynucleotide
tgttaaaacccacaggtgacgcagcatgtatg

SEQ ID NO: 4542 - DNA, 32 bp, Artificial Sequence
  Synthetic polynucleotide
cgtaatgttccactcgcaatccattacggaca

SEQ ID NO: 4543 - DNA, 32 bp, Artificial Sequence
  Synthetic polynucleotide
aactgtgtctgaggccttggccctcctcgcct

SEQ ID NO: 4544 - DNA, 32 bp, Artificial Sequence
  Synthetic polynucleotide
tgtaatattgggtactataaccatcctggtga

SEQ ID NO: 4545 - DNA, 32 bp, Artificial Sequence
  Synthetic polynucleotide
cccaggaagaccacccagactcgactagcacg

SEQ ID NO: 4546 - DNA, 32 bp, Artificial Sequence; identical to SEQ ID NO: 3356
  Synthetic polynucleotide

SEQ ID NO: 4547 - DNA, 32 bp, Artificial Sequence
  Synthetic polynucleotide
taatcgccgtgcagttcctgtagttgggtgtt

SEQ ID NO: 4548 - DNA, 32 bp, Artificial Sequence
  Synthetic polynucleotide
cttgacaacagtgaaataggacggctataaaa

SEQ ID NO: 4549 - DNA, 48 bp, Artificial Sequence
  Synthetic polynucleotide
atcagcccgggcttttgctaatacgctgagcgaactgttgtgtcctat

SEQ ID NO: 4550 - DNA, 48 bp, Artificial Sequence; identical to SEQ ID NO: 3369
  Synthetic polynucleotide

SEQ ID NO: 4551 - DNA, 48 bp, Artificial Sequence
  Synthetic polynucleotide
acgtaagttgaagtaggaagctttttctagcctgcgtacggcttttat

SEQ ID NO: 4552 - DNA, 48 bp, Artificial Sequence
  Synthetic polynucleotide
gccctttggggttcacttggagtgatgaacaacctgggtcctgctgcc

SEQ ID NO: 4553 - DNA, 48 bp, Artificial Sequence
  Synthetic polynucleotide
atgcggagaggtaggcagcgtcgcttaaagtggagtccccgaagaata

SEQ ID NO: 4554 - DNA, 48 bp, Artificial Sequence
  Synthetic polynucleotide
agctcattctcggtccgaaagatcataacgttgggatttgttccgcct

SEQ ID NO: 4555 - DNA, 48 bp, Artificial Sequence
  Synthetic polynucleotide
cggcagttgtgaaaggagtggcttcctaggtgctcctgaccctttaca

SEQ ID NO: 4556 - DNA, 48 bp, Artificial Sequence
  Synthetic polynucleotide
agggtaggcgtagagggggttgtggcgggggttaacgccgcggtagct

SEQ ID NO: 4557 - DNA, 48 bp, Artificial Sequence
  Synthetic polynucleotide
tgatcagccctgctaaaaaatatgcagggttagttgccctcgaccgat

SEQ ID NO: 4558 - DNA, 48 bp, Artificial Sequence
  Synthetic polynucleotide
tccgccacccctgacatcttcaaaagaaaccgcggaatgacggagcct

SEQ ID NO: 4559 - DNA, 32 bp, Artificial Sequence
  Synthetic polynucleotide
cgaatcaaaaagcaggttctgctagtacaaat

SEQ ID NO: 4560 - DNA, 32 bp, Artificial Sequence
  Synthetic polynucleotide
ttccgcgtgcaacctaaccgaagctgctgggt

SEQ ID NO: 4561 - DNA, 32 bp, Artificial Sequence
  Synthetic polynucleotide
cgtcgtctacgactttacttacgtgtagtgtc

SEQ ID NO: 4562 - DNA, 32 bp, Artificial Sequence
  Synthetic polynucleotide
cgtacgcaggctagaacaaagggctaggttat

SEQ ID NO: 4563 - DNA, 32 bp, Artificial Sequence
  Synthetic polynucleotide
agcaggtcggtgatctccaccttattacgagt

SEQ ID NO: 4564 - DNA, 32 bp, Artificial Sequence
  Synthetic polynucleotide
agccgaaccgtaccttcttccatgtaattata

SEQ ID NO: 4565 - DNA, 32 bp, Artificial Sequence
  Synthetic polynucleotide
aatgttctcaaaagatcgatagaaacaatttc

SEQ ID NO: 4566 - DNA, 32 bp, Artificial Sequence
  Synthetic polynucleotide
gatatcgctcaattttcgatgcttttgccaca

SEQ ID NO: 4567 - DNA, 32 bp, Artificial Sequence
  Synthetic polynucleotide
acattacttagcgcctctccgcatcatgttgt

SEQ ID NO: 4568 - DNA, 32 bp, Artificial Sequence
  Synthetic polynucleotide
ggggactccactttaaaatgagctgggacatg

SEQ ID NO: 4569 - DNA, 32 bp, Artificial Sequence
  Synthetic polynucleotide
actgtagtccatgcgaacattacgtacactcg

SEQ ID NO: 4570 - DNA, 32 bp, Artificial Sequence
  Synthetic polynucleotide
atattgtatttgcattttttaacataggtgct

SEQ ID NO: 4571 - DNA, 32 bp, Artificial Sequence
  Synthetic polynucleotide
ccgaagttacttcctgctaacgcgcaccaggt

SEQ ID NO: 4572 - DNA, 32 bp, Artificial Sequence
  Synthetic polynucleotide
cgtgtcgacatacatgacacagttcgcgtgta

SEQ ID NO: 4573 - DNA, 32 bp, Artificial Sequence
  Synthetic polynucleotide
agaggtcgtgtccgtaaactgccgaccagttt

SEQ ID NO: 4574 - DNA, 32 bp, Artificial Sequence
  Synthetic polynucleotide
gtcaggagcacctaggcctaccctccagcgta

SEQ ID NO: 4575 - DNA, 32 bp, Artificial Sequence
  Synthetic polynucleotide
tataccaaaggcgaggttcctgggcgcaagct

SEQ ID NO: 4576 - DNA, 32 bp, Artificial Sequence
  Synthetic polynucleotide
tttaagttgtaccgcaatattacacccttccc

SEQ ID NO: 4577 - DNA, 32 bp, Artificial Sequence
  Synthetic polynucleotide
cctacgccctcccgaataggtatgtgcatatt

SEQ ID NO: 4578 - DNA, 32 bp, Artificial Sequence
  Synthetic polynucleotide
ctagctagtcaccagggcgcggttgatgtgcc

SEQ ID NO: 4579 - DNA, 32 bp, Artificial Sequence
  Synthetic polynucleotide
gtcctacacgtgctaggctgatcaagatgtag

SEQ ID NO: 4580 - DNA, 48 bp, Artificial Sequence
  Synthetic polynucleotide
atatttaagcctcatagacacaacaataccttagcaagcacgccaggg

SEQ ID NO: 4581 - DNA, 48 bp, Artificial Sequence
  Synthetic polynucleotide
gtaggctcaagtccgtggcgattactgcgcagataacggacccgtgcg

SEQ ID NO: 4582 - DNA, 48 bp, Artificial Sequence
  Synthetic polynucleotide
atattagcaacacccaactacaggcggtgcatactacttaagacttag

SEQ ID NO: 4583 - DNA, 48 bp, Artificial Sequence
  Synthetic polynucleotide
cgcgaaggcctaaggtttgtcaagactagctcggttgagtaactccgg

SEQ ID NO: 4584 - DNA, 48 bp, Artificial Sequence
  Synthetic polynucleotide
taacgtgcttttatagccgtcctaaggctccgaggtagtcttagcagg

SEQ ID NO: 4585 - DNA, 48 bp, Artificial Sequence
  Synthetic polynucleotide
agggcaactaaccctggtggcggatcccccaaggcggctacggaggtc

SEQ ID NO: 4586 - DNA, 32 bp, Artificial Sequence; identical to SEQ ID NO: 11
  Synthetic polynucleotide

SEQ ID NO: 4587 - DNA, 32 bp, Artificial Sequence; identical to SEQ ID NO: 31
  Synthetic polynucleotide

SEQ ID NO: 4588 - DNA, 32 bp, Artificial Sequence
  Synthetic polynucleotide
ccgcctccggtagtcaacgcggaacgtaatgg

SEQ ID NO: 4589 - DNA, 32 bp, Artificial Sequence; identical to SEQ ID NO: 1984
  Synthetic polynucleotide

SEQ ID NO: 4590 - DNA, 32 bp, Artificial Sequence; identical to SEQ ID NO: 990
  Synthetic polynucleotide

SEQ ID NO: 4591 - DNA, 32 bp, Artificial Sequence
  Synthetic polynucleotide
tagggtatactcgtaagcgatatctgaatgcg

SEQ ID NO: 4592 - DNA, 32 bp, Artificial Sequence; identical to SEQ ID NO: 2068
  Synthetic polynucleotide

SEQ ID NO: 4593 - DNA, 32 bp, Artificial Sequence
  Synthetic polynucleotide
ttaagatgtgtggcaatacaatatagttatat

SEQ ID NO: 4594 - DNA, 32 bp, Artificial Sequence
  Synthetic polynucleotide
gtatcatccgagtgtatcgacacggtgataga

SEQ ID NO: 4595 - DNA, 32 bp, Artificial Sequence; identical to SEQ ID NO: 3560
  Synthetic polynucleotide

SEQ ID NO: 4596 - DNA, 32 bp, Artificial Sequence
  Synthetic polynucleotide
tcggacgttacacgcgaacttaaagatcgacg

SEQ ID NO: 4597 - DNA, 32 bp, Artificial Sequence
  Synthetic polynucleotide
gagtttcgagcttgcgctagctaggttttacg

SEQ ID NO: 4598 - DNA, 32 bp, Artificial Sequence; identical to SEQ ID NO: 3757
  Synthetic polynucleotide

SEQ ID NO: 4599 - DNA, 32 bp, Artificial Sequence
  Synthetic polynucleotide
ttttcgcaggcacatcgagcctacccgtctat

SEQ ID NO: 4600 - DNA, 32 bp, Artificial Sequence
  Synthetic polynucleotide
actcaaccgagctagtgctaatatcctctaag

SEQ ID NO: 4601 - DNA, 48 bp, Artificial Sequence
  Synthetic polynucleotide
aagatagggtcacagctacaatctcgaagtaaagcatagcaccctgcg

SEQ ID NO: 4602 - DNA, 48 bp, Artificial Sequence
  Synthetic polynucleotide
attgtaggcacaatttttgattcgatcacataccatagctaacccgat

SEQ ID NO: 4603 - DNA, 48 bp, Artificial Sequence
  Synthetic polynucleotide
caattactatttgtactagcagaataatttgcatccgaataaggtacg

SEQ ID NO: 4604 - DNA, 48 bp, Artificial Sequence
  Synthetic polynucleotide
gttaccgctataattaagaacattcgggttcgaagcgcacgtaaaccg

SEQ ID NO: 4605 - DNA, 48 bp, Artificial Sequence; identical to SEQ ID NO: 3136
  Synthetic polynucleotide

SEQ ID NO: 4606 - DNA, 48 bp, Artificial Sequence
  Synthetic polynucleotide
tactcatcagcacctaaacttcggggcgcattgttttgtgctcgacaa

SEQ ID NO: 4607 - DNA, 48 bp, Artificial Sequence
  Synthetic polynucleotide
aaccgataacctggtgcgcgttagatgttaacttatgcattgcggtac

SEQ ID NO: 4608 - DNA, 48 bp, Artificial Sequence
  Synthetic polynucleotide
aacgggatgggaagggggcgtaggggccgcacaaagtaatatgggttg

SEQ ID NO: 4609 - DNA, 48 bp, Artificial Sequence
  Synthetic polynucleotide
catcaagtaatatgcacatacctaccctggcgccttcatcacggactt

SEQ ID NO: 4610 - DNA, 48 bp, Artificial Sequence
  Synthetic polynucleotide
tccgttatctgcgcagttaaatatagtcggagaagatggggacaggac

SEQ ID NO: 4611 - DNA, 32 bp, Artificial Sequence
  Synthetic polynucleotide
agttactgataaaagcctcgttcgggtgctac

SEQ ID NO: 4612 - DNA, 32 bp, Artificial Sequence
  Synthetic polynucleotide
cacgacgatgtcgaaaggaggcgggggtatag

SEQ ID NO: 4613 - DNA, 32 bp, Artificial Sequence
  Synthetic polynucleotide
cgttactgcacaagggcctacaatagctttat

SEQ ID NO: 4614 - DNA, 32 bp, Artificial Sequence
  Synthetic polynucleotide
gtgcgcttcgaacccgagtaattgtatgccct

SEQ ID NO: 4615 - DNA, 32 bp, Artificial Sequence
  Synthetic polynucleotide
cctaggcgcgcattcaacactaatccgggtat

SEQ ID NO: 4616 - DNA, 32 bp, Artificial Sequence
  Synthetic polynucleotide
ggtattttggcactaggatgctattccagaat

SEQ ID NO: 4617 - DNA, 32 bp, Artificial Sequence
  Synthetic polynucleotide
cggcgccgtattcttcgcgcgggctgactctt

SEQ ID NO: 4618 - DNA, 32 bp, Artificial Sequence
  Synthetic polynucleotide
ggcggatacccggtcaataccctattgtcgtt

SEQ ID NO: 4619 - DNA, 32 bp, Artificial Sequence
  Synthetic polynucleotide
cgccgtgtatataactgcggtaacatcacata

SEQ ID NO: 4620 - DNA, 32 bp, Artificial Sequence
  Synthetic polynucleotide
cacaaaacaatgcgccaacatggtgcctcgtg

SEQ ID NO: 4621 - DNA, 32 bp, Artificial Sequence
  Synthetic polynucleotide
ctaatgtgtctatcaccatcttaacgaccgtt

SEQ ID NO: 4622 - DNA, 32 bp, Artificial Sequence
  Synthetic polynucleotide
cttggctttgggatctcttggacattgcgctt

SEQ ID NO: 4623 - DNA, 32 bp, Artificial Sequence
  Synthetic polynucleotide
cagccttctgtaaaggctcgaatttgttagct

SEQ ID NO: 4624 - DNA, 32 bp, Artificial Sequence
  Synthetic polynucleotide
tactcctgtatcaggagatgatacttaatggg

SEQ ID NO: 4625 - DNA, 32 bp, Artificial Sequence
  Synthetic polynucleotide
agttggtccgtcgatcgatgagtaccctatag

SEQ ID NO: 4626 - DNA, 32 bp, Artificial Sequence
  Synthetic polynucleotide
attactttgtgcggcctatcggttgtcgttac

SEQ ID NO: 4627 - DNA, 32 bp, Artificial Sequence
  Synthetic polynucleotide
aagcctgtcgtaaaacacgtccgaacgaatac

SEQ ID NO: 4628 - DNA, 32 bp, Artificial Sequence
  Synthetic polynucleotide
gtgatcctaacgtctacccacgttgacgcccc

SEQ ID NO: 4629 - DNA, 32 bp, Artificial Sequence
  Synthetic polynucleotide
caggcagcatcggtcgggctggttatctcatt

SEQ ID NO: 4630 - DNA, 32 bp, Artificial Sequence
  Synthetic polynucleotide
tggtcgcattgtcgggcgaaactcacctctct

SEQ ID NO: 4631 - DNA, 32 bp, Artificial Sequence
  Synthetic polynucleotide
gcttaactatagacggatcccgttcacagcgc

SEQ ID NO: 4632 - DNA, 48 bp, Artificial Sequence
  Synthetic polynucleotide
ggggtcacataggacacaacagttcgctcagccgaatcgcaggacgat

SEQ ID NO: 4633 - DNA, 48 bp, Artificial Sequence
  Synthetic polynucleotide
tttttgtcaggagatcaacagcatggcttcattagcccggctcccggt

SEQ ID NO: 4634 - DNA, 48 bp, Artificial Sequence
  Synthetic polynucleotide
cgagtcgtgttccggttcagaaaccacccccgcgtcttaatgactacc

SEQ ID NO: 4635 - DNA, 48 bp, Artificial Sequence
  Synthetic polynucleotide
caggctacccattacggccggagtagacgtgccacgcgagctatgtag

SEQ ID NO: 4636 - DNA, 48 bp, Artificial Sequence
  Synthetic polynucleotide
gtccaacatgggtaagctaatatacgcagggttccaaaccaaattgtg

SEQ ID NO: 4637 - DNA, 48 bp, Artificial Sequence
  Synthetic polynucleotide
agctatggtatgtgatcctatcttaggtagaggtattactttctggtc

SEQ ID NO: 4638 - DNA, 32 bp, Artificial Sequence; identical to SEQ ID NO: 32
  Synthetic polynucleotide

SEQ ID NO: 4639 - DNA, 32 bp, Artificial Sequence; identical to SEQ ID NO: 1943
  Synthetic polynucleotide

SEQ ID NO: 4640 - DNA, 32 bp, Artificial Sequence
  Synthetic polynucleotide
cagaaagtctatacccgacaaaaacagatttg

SEQ ID NO: 4641 - DNA, 32 bp, Artificial Sequence
  Synthetic polynucleotide
gactcgggatacccggtcgtcgtgtaatgctg

SEQ ID NO: 4642 - DNA, 32 bp, Artificial Sequence; identical to SEQ ID NO: 2027
  Synthetic polynucleotide

SEQ ID NO: 4643 - DNA, 32 bp, Artificial Sequence; identical to SEQ ID NO: 3571
  Synthetic polynucleotide

SEQ ID NO: 4644 - DNA, 32 bp, Artificial Sequence
  Synthetic polynucleotide
cctcatgtaacggtcgtatccgcctatctcgc

SEQ ID NO: 4645 - DNA, 32 bp, Artificial Sequence
  Synthetic polynucleotide
gtaagatactatagggcacattagagtgttgc

SEQ ID NO: 4646 - DNA, 32 bp, Artificial Sequence
  Synthetic polynucleotide
tcctcgcacccattaaaagccaagcggtcact

SEQ ID NO: 4647 - DNA, 32 bp, Artificial Sequence
  Synthetic polynucleotide
acgagattgtattcgtcaggagtaacccgacc

SEQ ID NO: 4648 - DNA, 32 bp, Artificial Sequence; identical to SEQ ID NO: 1304
  Synthetic polynucleotide

SEQ ID NO: 4649 - DNA, 32 bp, Artificial Sequence; identical to SEQ ID NO: 4216
  Synthetic polynucleotide

SEQ ID NO: 4650 - DNA, 32 bp, Artificial Sequence; identical to SEQ ID NO: 3380
  Synthetic polynucleotide

SEQ ID NO: 4651 - DNA, 32 bp, Artificial Sequence
  Synthetic polynucleotide
attaacgacgcacgggtcgaacctgctgtacg

SEQ ID NO: 4652 - DNA, 32 bp, Artificial Sequence
  Synthetic polynucleotide
gttctgtcccggagttttaaacgtgcccgcta

SEQ ID NO: 4653 - DNA, 48 bp, Artificial Sequence
  Synthetic polynucleotide
ccgggctaatgaagccgtgaccccagagactggtttacttagggatgg

SEQ ID NO: 4654 - DNA, 48 bp, Artificial Sequence; identical to SEQ ID NO: 3393
  Synthetic polynucleotide

SEQ ID NO: 4655 - DNA, 48 bp, Artificial Sequence
  Synthetic polynucleotide
cggactgcattctggacagtaactgcattaacatagcgtagaccggac

SEQ ID NO: 4656 - DNA, 48 bp, Artificial Sequence
  Synthetic polynucleotide
gtatgtgaaagagtcagcccgcgcataacctaagtaatgtctagtgcc

SEQ ID NO: 4657 - DNA, 48 bp, Artificial Sequence
  Synthetic polynucleotide
ggtgcaaaaagcgcaacggcgccgattgatcaggatattctccgccgg

SEQ ID NO: 4658 - DNA, 48 bp, Artificial Sequence
  Synthetic polynucleotide
atgttaggagctaacaaattcgagcatgtccccgacctctagatccca

SEQ ID NO: 4659 - DNA, 48 bp, Artificial Sequence
  Synthetic polynucleotide
cgcgagcaggggcgtcgaaggctgtctttgtgctccgaaatggaagtg

SEQ ID NO: 4660 - DNA, 48 bp, Artificial Sequence
  Synthetic polynucleotide
tataccttaatgagataaccagcctacgctggtgtaggactagacgtt

SEQ ID NO: 4661 - DNA, 48 bp, Artificial Sequence
  Synthetic polynucleotide
ctttgaaacctgtgctgctgcctgttgtcccctagggtgacgtattag

SEQ ID NO: 4662 - DNA, 48 bp, Artificial Sequence
  Synthetic polynucleotide
gcgcggaagacctccgtagccgccttgggggagcacgttaaatagacg

SEQ ID NO: 4663 - DNA, 32 bp, Artificial Sequence
  Synthetic polynucleotide
atatcaagatcgggtttgttttcgctaggtgg

SEQ ID NO: 4664 - DNA, 32 bp, Artificial Sequence
  Synthetic polynucleotide
ccgcacgtgcgcgcctcccgagtcttgattta

SEQ ID NO: 4665 - DNA, 32 bp, Artificial Sequence
  Synthetic polynucleotide
gcgttaaacaaatctggcagtccgatgttggg

SEQ ID NO: 4666 - DNA, 32 bp, Artificial Sequence
  Synthetic polynucleotide
tacgctatgttaatgctcacatacgtcaagac

SEQ ID NO: 4667 - DNA, 32 bp, Artificial Sequence
  Synthetic polynucleotide
cgtcacttcagcattatcgtattaggctccaa

SEQ ID NO: 4668 - DNA, 32 bp, Artificial Sequence
  Synthetic polynucleotide
tataaagctcgcttttgaccacgtcctctcct

SEQ ID NO: 4669 - DNA, 32 bp, Artificial Sequence
  Synthetic polynucleotide
gagctcaccggtttactcggcagcttgctagg

SEQ ID NO: 4670 - DNA, 32 bp, Artificial Sequence
  Synthetic polynucleotide
ggttcgtggaggttagacatgaggtggctggt

SEQ ID NO: 4671 - DNA, 32 bp, Artificial Sequence
  Synthetic polynucleotide
tggaatacccggcgaatttgcaccacctatac

SEQ ID NO: 4672 - DNA, 32 bp, Artificial Sequence
  Synthetic polynucleotide
gaatatcctgatcaatcctaacataggcgagt

SEQ ID NO: 4673 - DNA, 32 bp, Artificial Sequence
  Synthetic polynucleotide
taacaagggcgagatatgcgaggatagataag

SEQ ID NO: 4674 - DNA, 32 bp, Artificial Sequence
  Synthetic polynucleotide
gactctctatcgctgatatcttacttcccatc

SEQ ID NO: 4675 - DNA, 32 bp, Artificial Sequence
  Synthetic polynucleotide
ctcctagcttgtcgagtcgctttacagaatta

SEQ ID NO: 4676 - DNA, 32 bp, Artificial Sequence
  Synthetic polynucleotide
tagcactagcaacactaatctcgtccaacagg

SEQ ID NO: 4677 - DNA, 32 bp, Artificial Sequence
  Synthetic polynucleotide
acggaaacagtgaccgtgctcgcggggatttc

SEQ ID NO: 4678 - DNA, 32 bp, Artificial Sequence
  Synthetic polynucleotide
tttcggagcacaaagaaaggtatatgattcaa

SEQ ID NO: 4679 - DNA, 32 bp, Artificial Sequence
  Synthetic polynucleotide
tcggtgacggtcgggttttgctacgatatggc

SEQ ID NO: 4680 - DNA, 32 bp, Artificial Sequence
  Synthetic polynucleotide
ccgaaaattttcataggtggtccaattcatgg

SEQ ID NO: 4681 - DNA, 32 bp, Artificial Sequence
  Synthetic polynucleotide
cgctgtaacaacccatttggggcgtttgtgta

SEQ ID NO: 4682 - DNA, 32 bp, Artificial Sequence
  Synthetic polynucleotide
tagacattcggcgacgtgtgtccgagatggca

SEQ ID NO: 4683 - DNA, 32 bp, Artificial Sequence
  Synthetic polynucleotide
taacaccatgaacccttttcaaagtgggaccc

SEQ ID NO: 4684 - DNA, 48 bp, Artificial Sequence
  Synthetic polynucleotide
actcactggtcctgtccccatcttctccgactacttgatgaggagcag

SEQ ID NO: 4685 - DNA, 48 bp, Artificial Sequence
  Synthetic polynucleotide
agcgcgcccgtacagcaggttcgacttagaggtgcgaaaagcaagccg

SEQ ID NO: 4686 - DNA, 48 bp, Artificial Sequence
  Synthetic polynucleotide
tcaataattagcgggcacgtttaacgtctatttagggtcaagcacagg

SEQ ID NO: 4687 - DNA, 32 bp, Artificial Sequence; identical to SEQ ID NO: 1902
  Synthetic polynucleotide

SEQ ID NO: 4688 - DNA, 32 bp, Artificial Sequence; identical to SEQ ID NO: 33
  Synthetic polynucleotide

SEQ ID NO: 4689 - DNA, 32 bp, Artificial Sequence; identical to SEQ ID NO: 1958
  Synthetic polynucleotide

SEQ ID NO: 4690 - DNA, 32 bp, Artificial Sequence; identical to SEQ ID NO: 1986
  Synthetic polynucleotide

SEQ ID NO: 4691 - DNA, 32 bp, Artificial Sequence; identical to SEQ ID NO: 2000
  Synthetic polynucleotide

SEQ ID NO: 4692 - DNA, 32 bp, Artificial Sequence; identical to SEQ ID NO: 2042
  Synthetic polynucleotide

SEQ ID NO: 4693 - DNA, 32 bp, Artificial Sequence; identical to SEQ ID NO: 2070
  Synthetic polynucleotide

SEQ ID NO: 4694 - DNA, 32 bp, Artificial Sequence; identical to SEQ ID NO: 2084
  Synthetic polynucleotide

SEQ ID NO: 4695 - DNA, 32 bp, Artificial Sequence
  Synthetic polynucleotide
tcccagtacttatctatagtgctagtagtttc

SEQ ID NO: 4696 - DNA, 32 bp, Artificial Sequence; identical to SEQ ID NO: 3224
  Synthetic polynucleotide

SEQ ID NO: 4697 - DNA, 32 bp, Artificial Sequence
  Synthetic polynucleotide
ctccctgtcctgttggattttcggattttgtt

SEQ ID NO: 4698 - DNA, 32 bp, Artificial Sequence
  Synthetic polynucleotide
cccatgccgccatatcaatgtctagcatccgg

SEQ ID NO: 4699 - DNA, 32 bp, Artificial Sequence; identical to SEQ ID NO: 3817
  Synthetic polynucleotide

SEQ ID NO: 4700 - DNA, 32 bp, Artificial Sequence
  Synthetic polynucleotide
ctgtcatatgccatctgattgggagagtccag

SEQ ID NO: 4701 - DNA, 32 bp, Artificial Sequence
  Synthetic polynucleotide
cgttcgttagggggttggcgcgctatcactac

SEQ ID NO: 4702 - DNA, 48 bp, Artificial Sequence
  Synthetic polynucleotide
gaaataacgaccagaaagtaatacctctaccttgttggacgtaagcgt

SEQ ID NO: 4703 - DNA, 48 bp, Artificial Sequence
  Synthetic polynucleotide
acgagccaccacctagcgaaaacaagggcatacagtaacgaaaagcga

SEQ ID NO: 4704 - DNA, 48 bp, Artificial Sequence; identical to SEQ ID NO: 3148
  Synthetic polynucleotide

SEQ ID NO: 4705 - DNA, 48 bp, Artificial Sequence
  Synthetic polynucleotide
ggcgcacttaattctgtaaagcgagtaacgacgaccaactctatgaaa

SEQ ID NO: 4706 - DNA, 48 bp, Artificial Sequence
  Synthetic polynucleotide
accaatcgtacacaaacgccccaactgctcctagttaagcatgcttgg

SEQ ID NO: 4707 - DNA, 48 bp, Artificial Sequence
  Synthetic polynucleotide
ctgagcgttaacctcatttgagtaattcctcaatgaaccctttttttt

SEQ ID NO: 4708 - DNA, 48 bp, Artificial Sequence
  Synthetic polynucleotide
aatatgtcaaatctgaaattcgttttgcagattgcaattatttttttt

SEQ ID NO: 4709 - DNA, 48 bp, Artificial Sequence
  Synthetic polynucleotide
cagactctttagcaactagggctaacgtaaagaaattgactttttttt

SEQ ID NO: 4710 - DNA, 32 bp, Artificial Sequence; identical to SEQ ID NO: 63
  Synthetic polynucleotide

SEQ ID NO: 4711 - DNA, 32 bp, Artificial Sequence
  Synthetic polynucleotide
tcgtttactgcacggaacgagagtgctggcat

SEQ ID NO: 4712 - DNA, 32 bp, Artificial Sequence; identical to SEQ ID NO: 1014
  Synthetic polynucleotide

SEQ ID NO: 4713 - DNA, 32 bp, Artificial Sequence
  Synthetic polynucleotide
ggacgatatctgcgccagcgccacgtccccaa

SEQ ID NO: 4714 - DNA, 32 bp, Artificial Sequence; identical to SEQ ID NO: 4118
  Synthetic polynucleotide

SEQ ID NO: 4715 - DNA, 32 bp, Artificial Sequence
  Synthetic polynucleotide
aaccctcctacgttttgtaatgcgaaaccagg

SEQ ID NO: 4716 - DNA, 32 bp, Artificial Sequence; identical to SEQ ID NO: 1300
  Synthetic polynucleotide

SEQ ID NO: 4717 - DNA, 32 bp, Artificial Sequence
  Synthetic polynucleotide
taagcgtctcctcctccctgattgatatagag

SEQ ID NO: 4718 - DNA, 32 bp, Artificial Sequence; identical to SEQ ID NO: 4121
  Synthetic polynucleotide

SEQ ID NO: 4719 - DNA, 32 bp, Artificial Sequence
  Synthetic polynucleotide
gtcaatttctttacgttcacgattgtagaaat

SEQ ID NO: 4720 - DNA, 32 bp, Artificial Sequence
  Synthetic polynucleotide
ttttttttatccctgacataggtatttttttt

SEQ ID NO: 4721 - DNA, 32 bp, Artificial Sequence
  Synthetic polynucleotide
ttttttttgctgtattccagccgctttttttt

SEQ ID NO: 4722 - DNA, 32 bp, Artificial Sequence
  Synthetic polynucleotide
ttttttttatgccagcgacatgaatttttttt

SEQ ID NO: 4723 - DNA, 32 bp, Artificial Sequence
  Synthetic polynucleotide
ttttttttcatcgccggtaaacgatttttttt

SEQ ID NO: 4724 - DNA, 32 bp, Artificial Sequence
  Synthetic polynucleotide
tttttttttcgcgtcgtcatacgatttttttt

SEQ ID NO: 4725 - DNA, 32 bp, Artificial Sequence
  Synthetic polynucleotide
ttttttttgtggaaattaattagttttttttt

SEQ ID NO: 4726 - DNA, 32 bp, Artificial Sequence
  Synthetic polynucleotide
ttttttttggtcattgaccaatcatttttttt

SEQ ID NO: 4727 - DNA, 32 bp, Artificial Sequence
  Synthetic polynucleotide
ttttttttgggcacgatgcggcgctttttttt

SEQ ID NO: 4728 - DNA, 32 bp, Artificial Sequence
  Synthetic polynucleotide
ttttttttttggggactaagcgcgtttttttt

SEQ ID NO: 4729 - DNA, 32 bp, Artificial Sequence
  Synthetic polynucleotide
ttttttttaggcctcgtatcgtcctttttttt

SEQ ID NO: 4730 - DNA, 32 bp, Artificial Sequence
  Synthetic polynucleotide
tttttttttcaatttcttacgccctttttttt

SEQ ID NO: 4731 - DNA, 32 bp, Artificial Sequence
  Synthetic polynucleotide
ttttttttaaaacgacacttaatatttttttt

SEQ ID NO: 4732 - DNA, 32 bp, Artificial Sequence
  Synthetic polynucleotide
tttttttttgagccaaatcccctctttttttt

SEQ ID NO: 4733 - DNA, 32 bp, Artificial Sequence
  Synthetic polynucleotide
tttttttttattaatgcgtgacggtttttttt

SEQ ID NO: 4734 - DNA, 32 bp, Artificial Sequence
  Synthetic polynucleotide
ttttttttcctggtttacacagtgtttttttt

SEQ ID NO: 4735 - DNA, 32 bp, Artificial Sequence
  Synthetic polynucleotide
ttttttttatctgcttggagggtttttttttt

SEQ ID NO: 4736 - DNA, 32 bp, Artificial Sequence
  Synthetic polynucleotide
tttttttttcggtcacgacccacgtttttttt

SEQ ID NO: 4737 - DNA, 32 bp, Artificial Sequence
  Synthetic polynucleotide
ttttttttttcgccctgttacgactttttttt

SEQ ID NO: 4738 - DNA, 32 bp, Artificial Sequence
  Synthetic polynucleotide
ttttttttacaaacccttggaatgtttttttt

SEQ ID NO: 4739 - DNA, 32 bp, Artificial Sequence
  Synthetic polynucleotide
ttttttttcccgctgatagtgacgtttttttt

SEQ ID NO: 4740 - DNA, 32 bp, Artificial Sequence
  Synthetic polynucleotide
ttttttttctctatattggacaaatttttttt

SEQ ID NO: 4741 - DNA, 32 bp, Artificial Sequence
  Synthetic polynucleotide
ttttttttatcatctcgacgcttatttttttt

SEQ ID NO: 4742 - DNA, 32 bp, Artificial Sequence
  Synthetic polynucleotide
ttttttttctcatttgaaacatactttttttt

SEQ ID NO: 4743 - DNA, 32 bp, Artificial Sequence
  Synthetic polynucleotide
ttttttttcagaccggcgttgcactttttttt

SEQ ID NO: 4744 - DNA, 32 bp, Artificial Sequence
  Synthetic polynucleotide
tttttttttttggttacaaggacatttttttt

SEQ ID NO: 4745 - DNA, 32 bp, Artificial Sequence
  Synthetic polynucleotide
ttttttttcagtaagtgcacgtattttttttt

SEQ ID NO: 4746 - DNA, 32 bp, Artificial Sequence
  Synthetic polynucleotide
ttttttttatttctaccaagtgcctttttttt

SEQ ID NO: 4747 - DNA, 48 bp, Artificial Sequence
  Synthetic polynucleotide
ttttttttgagccacttaacctggtactcgattggatatctccgtgca

SEQ ID NO: 4748 - DNA, 48 bp, Artificial Sequence
  Synthetic polynucleotide
ttttttttaagtgtgtcaccgttcttatgctaagctctgttcctatga

SEQ ID NO: 4749 - DNA, 48 bp, Artificial Sequence
  Synthetic polynucleotide
tttttttttcagtcgtcgcacggcgcgtatccgtgggtaagttatgga

SEQ ID NO: 4750 - DNA, 48 bp, Artificial Sequence
  Synthetic polynucleotide
ggcttgcatccactgcagtgcccttatgcctataggaatgtttttttt

SEQ ID NO: 4751 - DNA, 48 bp, Artificial Sequence
  Synthetic polynucleotide
cacgcaaacttacctaagctccttttcacacaagtgcgactttttttt

SEQ ID NO: 4752 - DNA, 48 bp, Artificial Sequence
  Synthetic polynucleotide
taccctacaatgcccatttgtaaacggtttcttttgaagatttttttt

SEQ ID NO: 4753 - DNA, 32 bp, Artificial Sequence; identical to SEQ ID NO: 65
  Synthetic polynucleotide

SEQ ID NO: 4754 - DNA, 32 bp, Artificial Sequence; identical to SEQ ID NO: 1968
  Synthetic polynucleotide

SEQ ID NO: 4755 - DNA, 32 bp, Artificial Sequence; identical to SEQ ID NO: 1016
  Synthetic polynucleotide

SEQ ID NO: 4756 - DNA, 32 bp, Artificial Sequence; identical to SEQ ID NO: 2052
  Synthetic polynucleotide

SEQ ID NO: 4757 - DNA, 32 bp, Artificial Sequence; identical to SEQ ID NO: 4175
  Synthetic polynucleotide

SEQ ID NO: 4758 - DNA, 32 bp, Artificial Sequence
  Synthetic polynucleotide
gaaagatcataacgttgggatttgttccgcct

SEQ ID NO: 4759 - DNA, 32 bp, Artificial Sequence; identical to SEQ ID NO: 4176
  Synthetic polynucleotide

SEQ ID NO: 4760 - DNA, 32 bp, Artificial Sequence
  Synthetic polynucleotide
gggttgtggcgggggttaacgccgcggtagct

SEQ ID NO: 4761 - DNA, 32 bp, Artificial Sequence; identical to SEQ ID NO: 4178
  Synthetic polynucleotide

SEQ ID NO: 4762 - DNA, 32 bp, Artificial Sequence
  Synthetic polynucleotide
tcttcaaaagaaaccgcggaatgacggagcct

SEQ ID NO: 4763 - DNA, 32 bp, Artificial Sequence
  Synthetic polynucleotide
ttttttttagtgcgtatgacgatctttttttt

SEQ ID NO: 4764 - DNA, 32 bp, Artificial Sequence
  Synthetic polynucleotide
tttttttttaagccacgcgggccgtttttttt

SEQ ID NO: 4765 - DNA, 32 bp, Artificial Sequence
  Synthetic polynucleotide
ttttttttgcgaaaatgcaccgaatttttttt

SEQ ID NO: 4766 - DNA, 32 bp, Artificial Sequence
  Synthetic polynucleotide
ttttttttcgcgagcaccccaagttttttttt

SEQ ID NO: 4767 - DNA, 32 bp, Artificial Sequence
  Synthetic polynucleotide
ttttttttgtcctcacggaatgcatttttttt

SEQ ID NO: 4768 - DNA, 32 bp, Artificial Sequence
  Synthetic polynucleotide
ttttttttgctgccatgagtgcaatttttttt

SEQ ID NO: 4769 - DNA, 32 bp, Artificial Sequence
  Synthetic polynucleotide
ttttttttcacaggattgatcctgtttttttt

SEQ ID NO: 4770 - DNA, 32 bp, Artificial Sequence
  Synthetic polynucleotide
ttttttttcgaaggtctacgagcttttttttt

SEQ ID NO: 4771 - DNA, 32 bp, Artificial Sequence
  Synthetic polynucleotide
ttttttttggcagcaggcctggcctttttttt

SEQ ID NO: 4772 - DNA, 32 bp, Artificial Sequence
  Synthetic polynucleotide
ttttttttttagggtccactccaatttttttt

SEQ ID NO: 4773 - DNA, 32 bp, Artificial Sequence
  Synthetic polynucleotide
ttttttttggagtgtttaacagcatttttttt

SEQ ID NO: 4774 - DNA, 32 bp, Artificial Sequence; identical to SEQ ID NO: 4277
  Synthetic polynucleotide

SEQ ID NO: 4775 - DNA, 32 bp, Artificial Sequence
  Synthetic polynucleotide
ttttttttggggatgaattacgactttttttt

SEQ ID NO: 4776 - DNA, 32 bp, Artificial Sequence
  Synthetic polynucleotide
tttttttttgaacggtgaagaggttttttttt

SEQ ID NO: 4777 - DNA, 32 bp, Artificial Sequence
  Synthetic polynucleotide
ttttttttaggcggaagctcattctttttttt

SEQ ID NO: 4778 - DNA, 32 bp, Artificial Sequence
  Synthetic polynucleotide
ttttttttgcatgccggatctttctttttttt

SEQ ID NO: 4779 - DNA, 32 bp, Artificial Sequence
  Synthetic polynucleotide
ttttttttttatttacaccctggctttttttt

SEQ ID NO: 4780 - DNA, 32 bp, Artificial Sequence
  Synthetic polynucleotide
ttttttttgctgagagtgagtctatttttttt

SEQ ID NO: 4781 - DNA, 32 bp, Artificial Sequence
  Synthetic polynucleotide
ttttttttgtcactgccctagtcatttttttt

SEQ ID NO: 4782 - DNA, 32 bp, Artificial Sequence
  Synthetic polynucleotide
ttttttttacgggtacttatgtcgtttttttt

SEQ ID NO: 4783 - DNA, 32 bp, Artificial Sequence
  Synthetic polynucleotide
ttttttttagctaccgtacaggtgtttttttt

SEQ ID NO: 4784 - DNA, 32 bp, Artificial Sequence
  Synthetic polynucleotide
ttttttttcccagcggcacaaccctttttttt

SEQ ID NO: 4785 - DNA, 32 bp, Artificial Sequence
  Synthetic polynucleotide
tttttttttggttaggaagtgtgatttttttt

SEQ ID NO: 4786 - DNA, 32 bp, Artificial Sequence; identical to SEQ ID NO: 4283
  Synthetic polynucleotide

SEQ ID NO: 4787 - DNA, 32 bp, Artificial Sequence
  Synthetic polynucleotide
ttttttttaataccttagcaagcatttttttt

SEQ ID NO: 4788 - DNA, 32 bp, Artificial Sequence
  Synthetic polynucleotide
ttttttttcggtgcatactacttatttttttt

SEQ ID NO: 4789 - DNA, 32 bp, Artificial Sequence
  Synthetic polynucleotide
ttttttttaggctccgaggtagtctttttttt

SEQ ID NO: 4790 - DNA, 48 bp, Artificial Sequence
  Synthetic polynucleotide
ttttttttaaccgtgagtatgattgcggccattcttgcttatcttagt

SEQ ID NO: 4791 - DNA, 48 bp, Artificial Sequence
  Synthetic polynucleotide
tttttttttaagcgttacaggcggaggatatgggcggtaccaaacatt

SEQ ID NO: 4792 - DNA, 48 bp, Artificial Sequence
  Synthetic polynucleotide
ttttttttgaagcgtaatcgactattcataaccggtgagattccccag

SEQ ID NO: 4793 - DNA, 48 bp, Artificial Sequence
  Synthetic polynucleotide
tcccaatcccaagcattcgttaatcttctctgaatagttgtttttttt

SEQ ID NO: 4794 - DNA, 48 bp, Artificial Sequence
  Synthetic polynucleotide
gccgttctataaaactgacagaacaaccccctaacgaacgtttttttt

SEQ ID NO: 4795 - DNA, 48 bp, Artificial Sequence
  Synthetic polynucleotide
tcaccctaggggacaattccgcgcctgatcacccgctgaatttttttt

SEQ ID NO: 4796 - DNA, 32 bp, Artificial Sequence; identical to SEQ ID NO: 936
  Synthetic polynucleotide

SEQ ID NO: 4797 - DNA, 32 bp, Artificial Sequence; identical to SEQ ID NO: 419
  Synthetic polynucleotide

SEQ ID NO: 4798 - DNA, 32 bp, Artificial Sequence; identical to SEQ ID NO: 2028
  Synthetic polynucleotide

SEQ ID NO: 4799 - DNA, 32 bp, Artificial Sequence; identical to SEQ ID NO: 2055
  Synthetic polynucleotide

SEQ ID NO: 4800 - DNA, 32 bp, Artificial Sequence; identical to SEQ ID NO: 1222
  Synthetic polynucleotide

SEQ ID NO: 4801 - DNA, 32 bp, Artificial Sequence; identical to SEQ ID NO: 1248
  Synthetic polynucleotide

SEQ ID NO: 4802 - DNA, 32 bp, Artificial Sequence
  Synthetic polynucleotide
aaatgtagccatgaatttacagcgacgcctcg

SEQ ID NO: 4803 - DNA, 32 bp, Artificial Sequence
  Synthetic polynucleotide
ccagtggtttgaatcatggtgttagtttgtta

SEQ ID NO: 4804 - DNA, 32 bp, Artificial Sequence
  Synthetic polynucleotide
caactattcagagaagcagtgagtctagccaa

SEQ ID NO: 4805 - DNA, 32 bp, Artificial Sequence
  Synthetic polynucleotide
ttcagcgggtgatcagattattgaataatcct

SEQ ID NO: 4806 - DNA, 32 bp, Artificial Sequence
  Synthetic polynucleotide
ttttttttgtccctcagttatttctttttttt

SEQ ID NO: 4807 - DNA, 32 bp, Artificial Sequence
  Synthetic polynucleotide
ttttttttaggagaagaacagtcctttttttt

SEQ ID NO: 4808 - DNA, 32 bp, Artificial Sequence
  Synthetic polynucleotide
ttttttttggtctaaagcatcagatttttttt

SEQ ID NO: 4809 - DNA, 32 bp, Artificial Sequence
  Synthetic polynucleotide
ttttttttgtccggtctatttgactttttttt

SEQ ID NO: 4810 - DNA, 32 bp, Artificial Sequence
  Synthetic polynucleotide
ttttttttgctgaggaccccggtatttttttt

SEQ ID NO: 4811 - DNA, 32 bp, Artificial Sequence
  Synthetic polynucleotide
ttttttttcgggaattgtgcagcttttttttt

SEQ ID NO: 4812 - DNA, 32 bp, Artificial Sequence
  Synthetic polynucleotide
ttttttttccacgtagtggctcgttttttttt

SEQ ID NO: 4813 - DNA, 32 bp, Artificial Sequence
  Synthetic polynucleotide
ttttttttgatgcgttccccggaatttttttt

SEQ ID NO: 4814 - DNA, 32 bp, Artificial Sequence
  Synthetic polynucleotide
ttttttttcagctggaagcacgtatttttttt

SEQ ID NO: 4815 - DNA, 32 bp, Artificial Sequence
  Synthetic polynucleotide
ttttttttccggcggatttacgcttttttttt

SEQ ID NO: 4816 - DNA, 32 bp, Artificial Sequence
  Synthetic polynucleotide
tttttttttgccatcgcggacggatttttttt

SEQ ID NO: 4817 - DNA, 32 bp, Artificial Sequence
  Synthetic polynucleotide
ttttttttagggctgcggagtcattttttttt

SEQ ID NO: 4818 - DNA, 32 bp, Artificial Sequence
  Synthetic polynucleotide
ttttttttagctagcttagatgcgtttttttt

SEQ ID NO: 4819 - DNA, 32 bp, Artificial Sequence
  Synthetic polynucleotide
ttttttttgaaactacagaactcttttttttt

SEQ ID NO: 4820 - DNA, 32 bp, Artificial Sequence
  Synthetic polynucleotide
ttttttttaagaacgcttaaccattttttttt

SEQ ID NO: 4821 - DNA, 32 bp, Artificial Sequence
  Synthetic polynucleotide
ttttttttcacttccagtcgggtctttttttt

SEQ ID NO: 4822 - DNA, 32 bp, Artificial Sequence
  Synthetic polynucleotide
ttttttttagaaaacctactgggatttttttt

SEQ ID NO: 4823 - DNA, 32 bp, Artificial Sequence
  Synthetic polynucleotide
ttttttttaacaaaatgatcatgttttttttt

SEQ ID NO: 4824 - DNA, 32 bp, Artificial Sequence
  Synthetic polynucleotide
ttttttttcgaggcgtagtgcgcctttttttt

SEQ ID NO: 4825 - DNA, 32 bp, Artificial Sequence
  Synthetic polynucleotide
ttttttttccggatgcacagggagtttttttt

SEQ ID NO: 4826 - DNA, 32 bp, Artificial Sequence
  Synthetic polynucleotide
tttttttttaacaaacaatacccatttttttt

SEQ ID NO: 4827 - DNA, 32 bp, Artificial Sequence
  Synthetic polynucleotide
ttttttttctaatacgaccactggtttttttt

SEQ ID NO: 4828 - DNA, 32 bp, Artificial Sequence
  Synthetic polynucleotide
ttttttttgtgagacgggcatgggtttttttt

SEQ ID NO: 4829 - DNA, 32 bp, Artificial Sequence
  Synthetic polynucleotide
ttttttttctggactcctacattttttttttt

SEQ ID NO: 4830 - DNA, 32 bp, Artificial Sequence
  Synthetic polynucleotide
ttttttttttggctagcgattggttttttttt

SEQ ID NO: 4831 - DNA, 32 bp, Artificial Sequence
  Synthetic polynucleotide
ttttttttgtagtgattatgacagtttttttt

SEQ ID NO: 4832 - DNA, 32 bp, Artificial Sequence
  Synthetic polynucleotide
ttttttttaggattattatgacgatttttttt

SEQ ID NO: 4833 - DNA, 48 bp, Artificial Sequence
  Synthetic polynucleotide
ttttttttccatccctaagtaaaccagtctctcggcatgcagcacgca

SEQ ID NO: 4834 - DNA, 48 bp, Artificial Sequence
  Synthetic polynucleotide
ttttttttacagctaagtggctggtcgttcgaactttctggctgttca

SEQ ID NO: 4835 - DNA, 48 bp, Artificial Sequence
  Synthetic polynucleotide
ttttttttaacctcgtccaagtcaacgcttactgcccatggtgacacg

SEQ ID NO: 4836 - DNA, 16 bp, Artificial Sequence
  Synthetic polynucleotide
cactgagttttttttt

SEQ ID NO: 4837 - DNA, 16 bp, Artificial Sequence
  Synthetic polynucleotide
agcttgggtttttttt

SEQ ID NO: 4838 - DNA, 16 bp, Artificial Sequence
  Synthetic polynucleotide
gaacttgatttttttt

SEQ ID NO: 4839 - DNA, 16 bp, Artificial Sequence
  Synthetic polynucleotide
cacttgagtttttttt

SEQ ID NO: 4840 - DNA, 16 bp, Artificial Sequence
  Synthetic polynucleotide
ttttttttccgtctca

SEQ ID NO: 4841 - DNA, 16 bp, Artificial Sequence
  Synthetic polynucleotide
ttttttttgaagggcg

SEQ ID NO: 4842 - DNA, 16 bp, Artificial Sequence
  Synthetic polynucleotide
ttttttttggccgcgc

SEQ ID NO: 4843 - DNA, 16 bp, Artificial Sequence
  Synthetic polynucleotide
ttttttttcggttttc

SEQ ID NO: 4844 - DNA, 32 bp, Artificial Sequence
  Synthetic polynucleotide
caacatttttttttttttttttttttgccacc

SEQ ID NO: 4845 - DNA, 32 bp, Artificial Sequence
  Synthetic polynucleotide
cgaccatttttttttttttttttttcaccgaa

SEQ ID NO: 4846 - DNA, 32 bp, Artificial Sequence
  Synthetic polynucleotide
tgggagaattttttttttttttttatgtaccg

SEQ ID NO: 4847 - DNA, 32 bp, Artificial Sequence
  Synthetic polynucleotide
tatcgtccttttttttttttttttggaagttc

SEQ ID NO: 4848 - DNA, 32 bp, Artificial Sequence
  Synthetic polynucleotide
gtgccgtattttttttttttttttgcccacca

SEQ ID NO: 4849 - DNA, 32 bp, Artificial Sequence
  Synthetic polynucleotide
ctggtctctttttttttttttttttatcaaag

SEQ ID NO: 4850 - DNA, 32 bp, Artificial Sequence
  Synthetic polynucleotide
gcgccagattttttttttttttttagccattt

SEQ ID NO: 4851 - DNA, 32 bp, Artificial Sequence
  Synthetic polynucleotide
cgatgcggtttttttttttttttttgacggag

SEQ ID NO: 4852 - DNA, 32 bp, Artificial Sequence
  Synthetic polynucleotide
ggcaggcattttttttttttttttttttctta

SEQ ID NO: 4853 - DNA, 32 bp, Artificial Sequence
  Synthetic polynucleotide
ggagggttttttttttttttttttttgcgggg

SEQ ID NO: 4854 - DNA, 32 bp, Artificial Sequence
  Synthetic polynucleotide
gaggcagcttttttttttttttttaaagtgag

SEQ ID NO: 4855 - DNA, 32 bp, Artificial Sequence
  Synthetic polynucleotide
cgagttgattttttttttttttttgcgcccac

SEQ ID NO: 4856 - DNA, 32 bp, Artificial Sequence
  Synthetic polynucleotide
tcattaagtttttttttttttttttagtgttg

SEQ ID NO: 4857 - DNA, 32 bp, Artificial Sequence
  Synthetic polynucleotide
tctataacttttttttttttttttagaagatt

SEQ ID NO: 4858 - DNA, 32 bp, Artificial Sequence
  Synthetic polynucleotide
ccatatcattttttttttttttttccatttca

SEQ ID NO: 4859 - DNA, 32 bp, Artificial Sequence
  Synthetic polynucleotide
cacggcttttttttttttttttttacaaatta

SEQ ID NO: 4860 - DNA, 32 bp, Artificial Sequence; identical to SEQ ID NO: 4315
  Synthetic polynucleotide

SEQ ID NO: 4861 - DNA, 32 bp, Artificial Sequence; identical to SEQ ID NO: 4316
  Synthetic polynucleotide

SEQ ID NO: 4862 - DNA, 32 bp, Artificial Sequence; identical to SEQ ID NO: 4317
  Synthetic polynucleotide

SEQ ID NO: 4863 - DNA, 32 bp, Artificial Sequence
  Synthetic polynucleotide
gtccaggcttttttttttttttttaatcttgg

SEQ ID NO: 4864 - DNA, 32 bp, Artificial Sequence
  Synthetic polynucleotide
ttgcaaatttttttttttttttttaggtacct

SEQ ID NO: 4865 - DNA, 32 bp, Artificial Sequence
  Synthetic polynucleotide
tttatccattttttttttttttttctaccgat

SEQ ID NO: 4866 - DNA, 32 bp, Artificial Sequence
  Synthetic polynucleotide
aaattgacttttttttttttttttacagatgc

SEQ ID NO: 4867 - DNA, 32 bp, Artificial Sequence
  Synthetic polynucleotide
ctgattggttttttttttttttttgtggtggg

SEQ ID NO: 4868 - DNA, 32 bp, Artificial Sequence
  Synthetic polynucleotide
ggcgccgattttttttttttttttgacgtggg

SEQ ID NO: 4869 - DNA, 32 bp, Artificial Sequence
  Synthetic polynucleotide
cctaagtcttttttttttttttttgctgggaa

SEQ ID NO: 4870 - DNA, 32 bp, Artificial Sequence
  Synthetic polynucleotide
tattcaagttttttttttttttttttgatccg

SEQ ID NO: 4871 - DNA, 32 bp, Artificial Sequence
  Synthetic polynucleotide
agctgtacttttttttttttttttccggtgag

SEQ ID NO: 4872 - DNA, 32 bp, Artificial Sequence
  Synthetic polynucleotide
cgctgcttttttttttttttttttctttaagt

SEQ ID NO: 4873 - DNA, 32 bp, Artificial Sequence
  Synthetic polynucleotide
tggttacgttttttttttttttttgactgacc

SEQ ID NO: 4874 - DNA, 32 bp, Artificial Sequence
  Synthetic polynucleotide
cacactttttttttttttttttttaatttggg

SEQ ID NO: 4875 - DNA, 32 bp, Artificial Sequence
  Synthetic polynucleotide
gttggaaattttttttttttttttctaacgtc

SEQ ID NO: 4876 - DNA, 32 bp, Artificial Sequence
  Synthetic polynucleotide
gacaccggttttttttttttttttgaccgagc

SEQ ID NO: 4877 - DNA, 32 bp, Artificial Sequence
  Synthetic polynucleotide
tataaaagttttttttttttttttgaggcatg

SEQ ID NO: 4878 - DNA, 32 bp, Artificial Sequence
  Synthetic polynucleotide
ttgtggttttttttttttttttttagttaggg

SEQ ID NO: 4879 - DNA, 32 bp, Artificial Sequence
  Synthetic polynucleotide
cgcgtgggtttttttttttttttttgcctcct

SEQ ID NO: 4880 - DNA, 48 bp, Artificial Sequence
  Synthetic polynucleotide
cggggaggttttttttttttttttgagatgcggatactttgaaaaggc

SEQ ID NO: 4881 - DNA, 48 bp, Artificial Sequence
  Synthetic polynucleotide
gtaaacgattttttttttttttttctgacagacatcttttggggtcgt

SEQ ID NO: 4882 - DNA, 48 bp, Artificial Sequence
  Synthetic polynucleotide
cgaccatgttttttttttttttttctgctctaagctgttctccccgtc

SEQ ID NO: 4883 - DNA, 48 bp, Artificial Sequence
  Synthetic polynucleotide
ggtacaccttttttttttttttttacaacatagtgggtaagttatgga

SEQ ID NO: 4884 - DNA, 16 bp, Artificial Sequence
  Synthetic polynucleotide
ggtgtacctgtgggta

SEQ ID NO: 4885 - DNA, 16 bp, Artificial Sequence
  Synthetic polynucleotide
atacgacaggtggcaa

SEQ ID NO: 4886 - DNA, 16 bp, Artificial Sequence
  Synthetic polynucleotide
tacggcaccgaggcct

SEQ ID NO: 4887 - DNA, 16 bp, Artificial Sequence
  Synthetic polynucleotide
tccagagctaagaaaa

SEQ ID NO: 4888 - DNA, 16 bp, Artificial Sequence
  Synthetic polynucleotide
cttaatgacccgcttg

SEQ ID NO: 4889 - DNA, 16 bp, Artificial Sequence
  Synthetic polynucleotide
ggcaagagtcaggaat

SEQ ID NO: 4890 - DNA, 16 bp, Artificial Sequence
  Synthetic polynucleotide
atttgcaaaccaacga

SEQ ID NO: 4891 - DNA, 16 bp, Artificial Sequence
  Synthetic polynucleotide
aagcatggcccacgtc

SEQ ID NO: 4892 - DNA, 16 bp, Artificial Sequence
  Synthetic polynucleotide
aagcagcgcgcctgta

SEQ ID NO: 4893 - DNA, 16 bp, Artificial Sequence
  Synthetic polynucleotide
gttgggacgctcggtc

SEQ ID NO: 4894 - DNA, 16 bp, Artificial Sequence
  Synthetic polynucleotide
cggcaggagataagaa

SEQ ID NO: 4895 - DNA, 16 bp, Artificial Sequence
  Synthetic polynucleotide
tctatgccgaaaaccg

SEQ ID NO: 4896 - DNA, 32 bp, Artificial Sequence; identical to SEQ ID NO: 24
  Synthetic polynucleotide

SEQ ID NO: 4897 - DNA, 32 bp, Artificial Sequence; identical to SEQ ID NO: 370
  Synthetic polynucleotide

SEQ ID NO: 4898 - DNA, 32 bp, Artificial Sequence; identical to SEQ ID NO: 158
  Synthetic polynucleotide

SEQ ID NO: 4899 - DNA, 32 bp, Artificial Sequence; identical to SEQ ID NO: 414
  Synthetic polynucleotide

SEQ ID NO: 4900 - DNA, 32 bp, Artificial Sequence; identical to SEQ ID NO: 428
  Synthetic polynucleotide

SEQ ID NO: 4901 - DNA, 32 bp, Artificial Sequence; identical to SEQ ID NO: 2022
  Synthetic polynucleotide

SEQ ID NO: 4902 - DNA, 32 bp, Artificial Sequence; identical to SEQ ID NO: 3499
  Synthetic polynucleotide

SEQ ID NO: 4903 - DNA, 32 bp, Artificial Sequence; identical to SEQ ID NO: 2064
  Synthetic polynucleotide

SEQ ID NO: 4904 - DNA, 32 bp, Artificial Sequence; identical to SEQ ID NO: 4337
  Synthetic polynucleotide

SEQ ID NO: 4905 - DNA, 32 bp, Artificial Sequence; identical to SEQ ID NO: 2092
  Synthetic polynucleotide

SEQ ID NO: 4906 - DNA, 32 bp, Artificial Sequence
  Synthetic polynucleotide
gcgtatgctgaaatggaaccctcctacgtttt

SEQ ID NO: 4907 - DNA, 32 bp, Artificial Sequence
  Synthetic polynucleotide
agcttcgcaatcttctgctgcctctagggggg

SEQ ID NO: 4908 - DNA, 32 bp, Artificial Sequence
  Synthetic polynucleotide
cggtgaaaccaagattgttatagaagaataca

SEQ ID NO: 4909 - DNA, 32 bp, Artificial Sequence; identical to SEQ ID NO: 4089
  Synthetic polynucleotide

SEQ ID NO: 4910 - DNA, 32 bp, Artificial Sequence; identical to SEQ ID NO: 4342
  Synthetic polynucleotide

SEQ ID NO: 4911 - DNA, 32 bp, Artificial Sequence; identical to SEQ ID NO: 3308
  Synthetic polynucleotide

SEQ ID NO: 4912 - DNA, 32 bp, Artificial Sequence; identical to SEQ ID NO: 3500
  Synthetic polynucleotide

SEQ ID NO: 4913 - DNA, 32 bp, Artificial Sequence; identical to SEQ ID NO: 4345
  Synthetic polynucleotide

SEQ ID NO: 4914 - DNA, 32 bp, Artificial Sequence
  Synthetic polynucleotide
tagccctacggatcaagtcaatttctttacgt

SEQ ID NO: 4915 - DNA, 32 bp, Artificial Sequence
  Synthetic polynucleotide
aaccaaagttcccagcccaatcaggtcatcat

SEQ ID NO: 4916 - DNA, 32 bp, Artificial Sequence; identical to SEQ ID NO: 4092
  Synthetic polynucleotide

SEQ ID NO: 4917 - DNA, 32 bp, Artificial Sequence
  Synthetic polynucleotide
ctgtccgtggtcagtccttgaatatgcatcaa

SEQ ID NO: 4918 - DNA, 32 bp, Artificial Sequence
  Synthetic polynucleotide
gtctgaacaggaggcacgtaaccatccctcgc

SEQ ID NO: 4919 - DNA, 32 bp, Artificial Sequence; identical to SEQ ID NO: 1640
  Synthetic polynucleotide

SEQ ID NO: 4920 - DNA, 32 bp, Artificial Sequence
  Synthetic polynucleotide
tatactgccatgcctctttccaacaccggcac

SEQ ID NO: 4921 - DNA, 32 bp, Artificial Sequence
  Synthetic polynucleotide
ggagcgctctttcgaccttttatacagggtgc

SEQ ID NO: 4922 - DNA, 32 bp, Artificial Sequence
  Synthetic polynucleotide
atgacttttgaccgataaccacaaccatagtc

SEQ ID NO: 4923 - DNA, 32 bp, Artificial Sequence
  Synthetic polynucleotide
acacctagtgagacggcacgtatcaataaaag

SEQ ID NO: 4924 - DNA, 32 bp, Artificial Sequence
  Synthetic polynucleotide
actggttgcgcccttcagtttgcaccggggcg

SEQ ID NO: 4925 - DNA, 32 bp, Artificial Sequence
  Synthetic polynucleotide
atcgatgagcgcggccgatcagctctgtctgt

SEQ ID NO: 4926 - DNA, 48 bp, Artificial Sequence; identical to SEQ ID NO: 4346
  Synthetic polynucleotide

SEQ ID NO: 4927 - DNA, 48 bp, Artificial Sequence
  Synthetic polynucleotide
tcaggcttctccgtcaaaatgttggctgagatatatcagagagcacag

SEQ ID NO: 4928 - DNA, 48 bp, Artificial Sequence
  Synthetic polynucleotide
cggcgatttaatttgttgcctgccggtgtgagcccatgcagaaagata

SEQ ID NO: 4929 - DNA, 48 bp, Artificial Sequence; identical to SEQ ID NO: 4350
  Synthetic polynucleotide

SEQ ID NO: 4930 - DNA, 48 bp, Artificial Sequence
  Synthetic polynucleotide
tgcctcatgacgttagtcggcgcctggcattgggcccgagtctattgg

SEQ ID NO: 4931 - DNA, 48 bp, Artificial Sequence
  Synthetic polynucleotide
acttacgcagagttaaccggtgtcatctcgccgatctcatgggtattt

SEQ ID NO: 4932 - DNA, 32 bp, Artificial Sequence
  Synthetic polynucleotide
tagtttgatacccacattacacatttggggac

SEQ ID NO: 4933 - DNA, 32 bp, Artificial Sequence
  Synthetic polynucleotide
tcttgcttcagtagaaatcatgagttttttgt

SEQ ID NO: 4934 - DNA, 32 bp, Artificial Sequence
  Synthetic polynucleotide
tacatacgtccgtgcactctccgccggcgaaa

SEQ ID NO: 4935 - DNA, 32 bp, Artificial Sequence
  Synthetic polynucleotide
tgcggcgcttgtaatgaagcctgatacactaa

SEQ ID NO: 4936 - DNA, 32 bp, Artificial Sequence
  Synthetic polynucleotide
tctgatatatctcagcgctctggactctgata

SEQ ID NO: 4937 - DNA, 32 bp, Artificial Sequence
  Synthetic polynucleotide
actcgctacatattgtccacggaaggtatgct

SEQ ID NO: 4938 - DNA, 32 bp, Artificial Sequence
  Synthetic polynucleotide
atcgctcatatccattcatacacaccacaatg

SEQ ID NO: 4939 - DNA, 32 bp, Artificial Sequence
  Synthetic polynucleotide
taggcaagggcgcagaccagcagtaaacgtcc

SEQ ID NO: 4940 - DNA, 32 bp, Artificial Sequence
  Synthetic polynucleotide
tattgctcaggcctcgttaagagccgggcgac

SEQ ID NO: 4941 - DNA, 32 bp, Artificial Sequence
  Synthetic polynucleotide
gcggcgaaccggacgcgcgaagcttacaggca

SEQ ID NO: 4942 - DNA, 32 bp, Artificial Sequence
  Synthetic polynucleotide
ttgtgctgctaagccggcatacgccctggttt

SEQ ID NO: 4943 - DNA, 32 bp, Artificial Sequence
  Synthetic polynucleotide
gttacgaccccctcagaatcgccgaactctaa

SEQ ID NO: 4944 - DNA, 32 bp, Artificial Sequence
  Synthetic polynucleotide
tgcatgggctcacaccctcttgccgaggagga

SEQ ID NO: 4945 - DNA, 32 bp, Artificial Sequence
  Synthetic polynucleotide
aggcagtcaaaacgtaagtatgaaagtatcca

SEQ ID NO: 4946 - DNA, 32 bp, Artificial Sequence
  Synthetic polynucleotide
aataggctcccccctatcaggatcgtgtttcc

SEQ ID NO: 4947 - DNA, 32 bp, Artificial Sequence
  Synthetic polynucleotide
gactattgagtgtgtatttcaccgtctcgata

SEQ ID NO: 4948 - DNA, 32 bp, Artificial Sequence
  Synthetic polynucleotide
tgtgtggacaagcgggtttgagtaattcctca

SEQ ID NO: 4949 - DNA, 32 bp, Artificial Sequence
  Synthetic polynucleotide
cgggcccatgtattcttgactgtgatcgcgga

SEQ ID NO: 4950 - DNA, 32 bp, Artificial Sequence; identical to SEQ ID NO: 4370
  Synthetic polynucleotide

SEQ ID NO: 4951 - DNA, 32 bp, Artificial Sequence; identical to SEQ ID NO: 4371
  Synthetic polynucleotide

SEQ ID NO: 4952 - DNA, 32 bp, Artificial Sequence
  Synthetic polynucleotide
cagactctttagcaacccatgcttatagaggt

SEQ ID NO: 4953 - DNA, 32 bp, Artificial Sequence
  Synthetic polynucleotide
aatatgtcaaatctgactttggttgcgctcga

SEQ ID NO: 4954 - DNA, 32 bp, Artificial Sequence
  Synthetic polynucleotide
ctgagcgttaacctcatagggctaatttctac

SEQ ID NO: 4955 - DNA, 32 bp, Artificial Sequence
  Synthetic polynucleotide
cggacgaaaataaatgaattcgttttgcagat

SEQ ID NO: 4956 - DNA, 32 bp, Artificial Sequence
  Synthetic polynucleotide
agggggactcgttggtagccctcctcaaagag

SEQ ID NO: 4957 - DNA, 32 bp, Artificial Sequence
  Synthetic polynucleotide
tttgtaaatagaagttacggacaggagaagcg

SEQ ID NO: 4958 - DNA, 32 bp, Artificial Sequence
  Synthetic polynucleotide
atttgggcacgtaaaggttagttctacaaatt

SEQ ID NO: 4959 - DNA, 32 bp, Artificial Sequence
  Synthetic polynucleotide
gacgagtaatgatgacatgaggcagaacacgt

SEQ ID NO: 4960 - DNA, 32 bp, Artificial Sequence
  Synthetic polynucleotide
ctcgggcccaatgccagtcccaactagttttc

SEQ ID NO: 4961 - DNA, 32 bp, Artificial Sequence
  Synthetic polynucleotide
ggtcacgcccatccgggcagtataccgtctac

SEQ ID NO: 4962 - DNA, 32 bp, Artificial Sequence
  Synthetic polynucleotide
gagaggtgttgatgcaggatgactcttacatc

SEQ ID NO: 4963 - DNA, 32 bp, Artificial Sequence
  Synthetic polynucleotide
ctctgggtctctcattgttcagacctgtgtgc

SEQ ID NO: 4964 - DNA, 32 bp, Artificial Sequence
  Synthetic polynucleotide
ttagggtttacaggcgaagcgtggccttgtac

SEQ ID NO: 4965 - DNA, 32 bp, Artificial Sequence
  Synthetic polynucleotide
agcgtgttgcgagggaaaagtcatgaatcgga

SEQ ID NO: 4966 - DNA, 32 bp, Artificial Sequence
  Synthetic polynucleotide
accgttgacgaactcaagcgctccccgtatta

SEQ ID NO: 4967 - DNA, 32 bp, Artificial Sequence
  Synthetic polynucleotide
tgtgcacggtgccggtgcgtaagtgcttgcca

SEQ ID NO: 4968 - DNA, 48 bp, Artificial Sequence
  Synthetic polynucleotide
gttgacctttcttatctcctgccgttttttttttttttttttatagat

SEQ ID NO: 4969 - DNA, 48 bp, Artificial Sequence
  Synthetic polynucleotide
agccttttcttttattgatacgtgttttttttttttttttatcggtca

SEQ ID NO: 4970 - DNA, 48 bp, Artificial Sequence
  Synthetic polynucleotide
tcggtggacgccccggtgcaaactttttttttttttttttgtcgaaag

SEQ ID NO: 4971 - DNA, 48 bp, Artificial Sequence
  Synthetic polynucleotide
tggcaaagacagacagagctgatcttttttttttttttttttaactct

SEQ ID NO: 4972 - DNA, 32 bp, Artificial Sequence; identical to SEQ ID NO: 7
  Synthetic polynucleotide

SEQ ID NO: 4973 - DNA, 32 bp, Artificial Sequence; identical to SEQ ID NO: 3319
  Synthetic polynucleotide

SEQ ID NO: 4974 - DNA, 32 bp, Artificial Sequence; identical to SEQ ID NO: 45
  Synthetic polynucleotide

SEQ ID NO: 4975 - DNA, 32 bp, Artificial Sequence; identical to SEQ ID NO: 1967
  Synthetic polynucleotide

SEQ ID NO: 4976 - DNA, 32 bp, Artificial Sequence; identical to SEQ ID NO: 429
  Synthetic polynucleotide

SEQ ID NO: 4977 - DNA, 32 bp, Artificial Sequence; identical to SEQ ID NO: 2009
  Synthetic polynucleotide

SEQ ID NO: 4978 - DNA, 32 bp, Artificial Sequence; identical to SEQ ID NO: 1014
  Synthetic polynucleotide

SEQ ID NO: 4979 - DNA, 32 bp, Artificial Sequence; identical to SEQ ID NO: 4380
  Synthetic polynucleotide

SEQ ID NO: 4980 - DNA, 32 bp, Artificial Sequence; identical to SEQ ID NO: 3664
  Synthetic polynucleotide

SEQ ID NO: 4981 - DNA, 32 bp, Artificial Sequence; identical to SEQ ID NO: 2093
  Synthetic polynucleotide

SEQ ID NO: 4982 - DNA, 32 bp, Artificial Sequence; identical to SEQ ID NO: 4383
  Synthetic polynucleotide

SEQ ID NO: 4983 - DNA, 32 bp, Artificial Sequence; identical to SEQ ID NO: 3320
  Synthetic polynucleotide

SEQ ID NO: 4984 - DNA, 32 bp, Artificial Sequence; identical to SEQ ID NO: 3215
  Synthetic polynucleotide

SEQ ID NO: 4985 - DNA, 32 bp, Artificial Sequence; identical to SEQ ID NO: 1300
  Synthetic polynucleotide

SEQ ID NO: 4986 - DNA, 32 bp, Artificial Sequence; identical to SEQ ID NO: 4386
  Synthetic polynucleotide

SEQ ID NO: 4987 - DNA, 32 bp, Artificial Sequence; identical to SEQ ID NO: 4387
  Synthetic polynucleotide

SEQ ID NO: 4988 - DNA, 32 bp, Artificial Sequence; identical to SEQ ID NO: 4120
  Synthetic polynucleotide

SEQ ID NO: 4989 - DNA, 32 bp, Artificial Sequence
  Synthetic polynucleotide
tgtccttgtccgcgatttcgtccggtgctcta

SEQ ID NO: 4990 - DNA, 32 bp, Artificial Sequence; identical to SEQ ID NO: 3666
  Synthetic polynucleotide

SEQ ID NO: 4991 - DNA, 32 bp, Artificial Sequence
  Synthetic polynucleotide
acggaaattcgagcgcgcccaaatggtggacg

SEQ ID NO: 4992 - DNA, 32 bp, Artificial Sequence
  Synthetic polynucleotide
gtaggccgacgtgttcgcgtgacctacagagg

SEQ ID NO: 4993 - DNA, 32 bp, Artificial Sequence; identical to SEQ ID NO: 4122
  Synthetic polynucleotide

SEQ ID NO: 4994 - DNA, 32 bp, Artificial Sequence
  Synthetic polynucleotide
tcagatcccgcttctcacccagaggttaacca

SEQ ID NO: 4995 - DNA, 32 bp, Artificial Sequence
  Synthetic polynucleotide
agacgtccgatgtaagaacacgctaaaccaag

SEQ ID NO: 4996 - DNA, 32 bp, Artificial Sequence
  Synthetic polynucleotide
attagtacgtagacggtcaacggtcatacttt

SEQ ID NO: 4997 - DNA, 32 bp, Artificial Sequence
  Synthetic polynucleotide
gagattgttggcaagccggtgtccggggcatc

SEQ ID NO: 4998 - DNA, 32 bp, Artificial Sequence
  Synthetic polynucleotide
gcccgttctaatacggcaacgccttcagatga

SEQ ID NO: 4999 - DNA, 32 bp, Artificial Sequence
  Synthetic polynucleotide
ttacaggatccgattcggtctcattctgtcag

SEQ ID NO: 5000 - DNA, 32 bp, Artificial Sequence
  Synthetic polynucleotide
taggagtgttcgctttaaaaggctggtcgtga

SEQ ID NO: 5001 - DNA, 32 bp, Artificial Sequence
  Synthetic polynucleotide
ttggtgaaaagctttttccaccgacgaaggct

SEQ ID NO: 5002 - DNA, 48 bp, Artificial Sequence
  Synthetic polynucleotide
actaattatccataacttacccactatgttgtctcaagtgctaacagt

SEQ ID NO: 5003 - DNA, 48 bp, Artificial Sequence
  Synthetic polynucleotide
agcgccacgtccccaaatgtgtaatggtgggcggacgatatctgcgcc

SEQ ID NO: 5004 - DNA, 48 bp, Artificial Sequence; identical to SEQ ID NO: 2986
  Synthetic polynucleotide

SEQ ID NO: 5005 - DNA, 48 bp, Artificial Sequence
  Synthetic polynucleotide
gggttcattgaggaattactcaaaaggtacctgcctggaccatttatt

SEQ ID NO: 5006 - DNA, 48 bp, Artificial Sequence
  Synthetic polynucleotide
aggcggatctctttgaggagggctacttaaaggtacagctaatgagag

SEQ ID NO: 5007 - DNA, 48 bp, Artificial Sequence
  Synthetic polynucleotide
gtgccgatgtacaaggccacgcttatctataacccacgcggaacatca

SEQ ID NO: 5008 - DNA, 48 bp, Artificial Sequence
  Synthetic polynucleotide
atgagacctgatgttcctaggtgtcactttcagttctaaaaattgtgc

SEQ ID NO: 5009 - DNA, 48 bp, Artificial Sequence
  Synthetic polynucleotide
aggcgttggactatggcaaccagtaaagcgaacactcctaattcgaag

SEQ ID NO: 5010 - DNA, 48 bp, Artificial Sequence
  Synthetic polynucleotide
ggacaccggcaccctgtcatcgataaaagcttttcaccaagaaataag

SEQ ID NO: 5011 - DNA, 48 bp, Artificial Sequence
  Synthetic polynucleotide
atgagatcggcgagatggcatagatgcattacagcccgcccagggtgc

SEQ ID NO: 5012 - DNA, 48 bp, Artificial Sequence
  Synthetic polynucleotide
tcgtatgatcataggatcaaactaaatacagcgggccgagcgctgggc

SEQ ID NO: 5013 - DNA, 48 bp, Artificial Sequence
  Synthetic polynucleotide
cactgtgtggacgtttgagcaatagaaattgaaatccgatgaccctaa

SEQ ID NO: 5014 - DNA, 48 bp, Artificial Sequence
  Synthetic polynucleotide
cattccaatatcgagatccacacaagcaaagaagtaaggacattacac

SEQ ID NO: 5015 - DNA, 48 bp, Artificial Sequence
  Synthetic polynucleotide
taattgcaatctgcaagtccccctacttactggcaaccgctctaagac

SEQ ID NO: 5016 - DNA, 48 bp, Artificial Sequence
  Synthetic polynucleotide
aacaacccgcacacagaaccctaatgcggacatgactagactgccgac

SEQ ID NO: 5017 - DNA, 48 bp, Artificial Sequence
  Synthetic polynucleotide
tttagaactgaaagtgaggtcaacgtaccgatggcttccgtaggtatc

SEQ ID NO: 5018 - DNA, 32 bp, Artificial Sequence
  Synthetic polynucleotide
tgatcctgctgtgctcgaggtggtgtggaaat

SEQ ID NO: 5019 - DNA, 32 bp, Artificial Sequence
  Synthetic polynucleotide
gcagggtgtatctctttaagcgcgcacccgtt

SEQ ID NO: 5020 - DNA, 32 bp, Artificial Sequence
  Synthetic polynucleotide
taggtggtggtcattgactctcgtatcttagt

SEQ ID NO: 5021 - DNA, 32 bp, Artificial Sequence
  Synthetic polynucleotide
cactccaagggcacgatcatacgacaagaact

SEQ ID NO: 5022 - DNA, 32 bp, Artificial Sequence
  Synthetic polynucleotide
atcggatttcaatttcgtggcgcttgacaggt

SEQ ID NO: 5023 - DNA, 32 bp, Artificial Sequence
  Synthetic polynucleotide
gagccgataaaacgacttacgcccagacaatg

SEQ ID NO: 5024 - DNA, 32 bp, Artificial Sequence
  Synthetic polynucleotide
cgtcctgtgcgagggtacttaatattcaggct

SEQ ID NO: 5025 - DNA, 32 bp, Artificial Sequence
  Synthetic polynucleotide
attacgacgcgaccgaaccaatcataatgatc

SEQ ID NO: 5026 - DNA, 32 bp, Artificial Sequence
  Synthetic polynucleotide
tgacactgtatctttctcacgaggtgagccaa

SEQ ID NO: 5027 - DNA, 32 bp, Artificial Sequence
  Synthetic polynucleotide
caaatccctattaatgatcccctctaacggcc

SEQ ID NO: 5028 - DNA, 32 bp, Artificial Sequence
  Synthetic polynucleotide
gtcggcccccttgatgcgtgacggtgaatctt

SEQ ID NO: 5029 - DNA, 32 bp, Artificial Sequence
  Synthetic polynucleotide
ttgcggtatcggtcacacacagtgtgcagggt

SEQ ID NO: 5030 - DNA, 32 bp, Artificial Sequence
  Synthetic polynucleotide
tccttacttctttgcttagtgacgttcgccct

SEQ ID NO: 5031 - DNA, 32 bp, Artificial Sequence
  Synthetic polynucleotide
cctagtcaacaaaccctggacaaattcgcgtg

SEQ ID NO: 5032 - DNA, 32 bp, Artificial Sequence
  Synthetic polynucleotide
gtgtaagacccgctgacgcattacaacgttat

SEQ ID NO: 5033 - DNA, 32 bp, Artificial Sequence
  Synthetic polynucleotide
tgaaagaactctatatgacccacgttaatcct

SEQ ID NO: 5034 - DNA, 32 bp, Artificial Sequence; identical to SEQ ID NO: 4421
  Synthetic polynucleotide

SEQ ID NO: 5035 - DNA, 32 bp, Artificial Sequence; identical to SEQ ID NO: 4422
  Synthetic polynucleotide

SEQ ID NO: 5036 - DNA, 32 bp, Artificial Sequence
  Synthetic polynucleotide
agcaagcacagaccggcgttgcacattgtacc

SEQ ID NO: 5037 - DNA, 32 bp, Artificial Sequence
  Synthetic polynucleotide
agtgcccttagagcacttggaatgctaactat

SEQ ID NO: 5038 - DNA, 32 bp, Artificial Sequence
  Synthetic polynucleotide
gcggttgccagtaagtatgaaccctttggtta

SEQ ID NO: 5039 - DNA, 32 bp, Artificial Sequence
  Synthetic polynucleotide
tgttaggatgtccgtccaaggacatccactgc

SEQ ID NO: 5040 - DNA, 32 bp, Artificial Sequence
  Synthetic polynucleotide
tcattccgcgtccaccgcacgtatgtcttgag

SEQ ID NO: 5041 - DNA, 32 bp, Artificial Sequence
  Synthetic polynucleotide
acgaggcttctattctcaagtgcccgtaaaac

SEQ ID NO: 5042 - DNA, 32 bp, Artificial Sequence
  Synthetic polynucleotide
tcgaggttccaatagacagactggaactttgg

SEQ ID NO: 5043 - DNA, 32 bp, Artificial Sequence
  Synthetic polynucleotide
actctctgcctctgtaatttccgtaacgccac

SEQ ID NO: 5044 - DNA, 32 bp, Artificial Sequence
  Synthetic polynucleotide
cgctaagttggcaagcaatcgtgacggtttct

SEQ ID NO: 5045 - DNA, 32 bp, Artificial Sequence
  Synthetic polynucleotide
caaacagctggttaactgcaattaagagtcta

SEQ ID NO: 5046 - DNA, 32 bp, Artificial Sequence
  Synthetic polynucleotide
tctagtcatgtccgcaatccgccttcgccggg

SEQ ID NO: 5047 - DNA, 32 bp, Artificial Sequence
  Synthetic polynucleotide
tcagcaggcttggtttggatctgatacaccct

SEQ ID NO: 5048 - DNA, 32 bp, Artificial Sequence
  Synthetic polynucleotide
gggttccgaaagtatgttccgattttcccttt

SEQ ID NO: 5049 - DNA, 32 bp, Artificial Sequence
  Synthetic polynucleotide
taccgcagaaccgtcccggcctacttgtattc

SEQ ID NO: 5050 - DNA, 32 bp, Artificial Sequence
  Synthetic polynucleotide
tcttctacaaatacccgtagaatggggatatg

SEQ ID NO: 5051 - DNA, 32 bp, Artificial Sequence
  Synthetic polynucleotide
gttcgcctgatgccccgtactaatcgcctctt

SEQ ID NO: 5052 - DNA, 32 bp, Artificial Sequence
  Synthetic polynucleotide
agttgatatcatctgaggacgtcttaaccgca

SEQ ID NO: 5053 - DNA, 32 bp, Artificial Sequence
  Synthetic polynucleotide
gcataggactgacagagggttgtttttttaca

SEQ ID NO: 5054 - DNA, 48 bp, Artificial Sequence
  Synthetic polynucleotide
atttccgcgagccacttaacctggtactcgattgtcgtattgacatcg

SEQ ID NO: 5055 - DNA, 48 bp, Artificial Sequence
  Synthetic polynucleotide
aattcatcaatgggtagacatgaatactctgaatgaacaccccgctgc

SEQ ID NO: 5056 - DNA, 48 bp, Artificial Sequence
  Synthetic polynucleotide
cgtttgtcaagtgtgtcaccgttcttatgctatacttgaattacttgg

SEQ ID NO: 5057 - DNA, 48 bp, Artificial Sequence
  Synthetic polynucleotide
tcgcaacgtcgcgtcgccagccgcgcgcagggctcgacggttaatttg

SEQ ID NO: 5058 - DNA, 48 bp, Artificial Sequence
  Synthetic polynucleotide
tgacgatctcagtcgtcgcacggcgcgtatcctggatatcatgccagc

SEQ ID NO: 5059 - DNA, 48 bp, Artificial Sequence
  Synthetic polynucleotide
aataaggataggtttccataggtattcataactcatccggttacttcg

SEQ ID NO: 5060 - DNA, 48 bp, Artificial Sequence
  Synthetic polynucleotide
cggtgagaatcatggtgtcgcataactgttagagctctgttcctatga

SEQ ID NO: 5061 - DNA, 48 bp, Artificial Sequence
  Synthetic polynucleotide
ctcggcccgctgtatttaattagtatccctgacgtgcacaagaaactg

SEQ ID NO: 5062 - DNA, 32 bp, Artificial Sequence; identical to SEQ ID NO: 4430
  Synthetic polynucleotide

SEQ ID NO: 5063 - DNA, 32 bp, Artificial Sequence; identical to SEQ ID NO: 46
  Synthetic polynucleotide

SEQ ID NO: 5064 - DNA, 32 bp, Artificial Sequence; identical to SEQ ID NO: 4432
  Synthetic polynucleotide

SEQ ID NO: 5065 - DNA, 32 bp, Artificial Sequence; identical to SEQ ID NO: 1968
  Synthetic polynucleotide

SEQ ID NO: 5066 - DNA, 32 bp, Artificial Sequence; identical to SEQ ID NO: 431
  Synthetic polynucleotide

SEQ ID NO: 5067 - DNA, 32 bp, Artificial Sequence; identical to SEQ ID NO: 3331
  Synthetic polynucleotide

SEQ ID NO: 5068 - DNA, 32 bp, Artificial Sequence; identical to SEQ ID NO: 3523
  Synthetic polynucleotide

SEQ ID NO: 5069 - DNA, 32 bp, Artificial Sequence
  Synthetic polynucleotide
tatgagttaccctgcaatcggctcaagacgta

SEQ ID NO: 5070 - DNA, 32 bp, Artificial Sequence; identical to SEQ ID NO: 4436
  Synthetic polynucleotide

SEQ ID NO: 5071 - DNA, 32 bp, Artificial Sequence; identical to SEQ ID NO: 2094
  Synthetic polynucleotide

SEQ ID NO: 5072 - DNA, 32 bp, Artificial Sequence; identical to SEQ ID NO: 4758
  Synthetic polynucleotide

SEQ ID NO: 5073 - DNA, 32 bp, Artificial Sequence
  Synthetic polynucleotide
gcgctagtcacgcgaagggccgacaatcggcg

SEQ ID NO: 5074 - DNA, 32 bp, Artificial Sequence
  Synthetic polynucleotide
tccttggcatagttagtgactaggtttagttt

SEQ ID NO: 5075 - DNA, 32 bp, Artificial Sequence; identical to SEQ ID NO: 4149
  Synthetic polynucleotide

SEQ ID NO: 5076 - DNA, 32 bp, Artificial Sequence; identical to SEQ ID NO: 4441
  Synthetic polynucleotide

SEQ ID NO: 5077 - DNA, 32 bp, Artificial Sequence; identical to SEQ ID NO: 1356
  Synthetic polynucleotide

SEQ ID NO: 5078 - DNA, 32 bp, Artificial Sequence; identical to SEQ ID NO: 3524
  Synthetic polynucleotide

SEQ ID NO: 5079 - DNA, 32 bp, Artificial Sequence; identical to SEQ ID NO: 4444
  Synthetic polynucleotide

SEQ ID NO: 5080 - DNA, 32 bp, Artificial Sequence; identical to SEQ ID NO: 4762
  Synthetic polynucleotide

SEQ ID NO: 5081 - DNA, 32 bp, Artificial Sequence
  Synthetic polynucleotide
ctatagccgtggcgttagcctcgtaagtcaat

SEQ ID NO: 5082 - DNA, 32 bp, Artificial Sequence; identical to SEQ ID NO: 4152
  Synthetic polynucleotide

SEQ ID NO: 5083 - DNA, 32 bp, Artificial Sequence
  Synthetic polynucleotide
tctaaggcagggtgtaacttagcgtctatctg

SEQ ID NO: 5084 - DNA, 32 bp, Artificial Sequence
  Synthetic polynucleotide
aggcaccatgtaaaaacctgctgagcagacct

SEQ ID NO: 5085 - DNA, 32 bp, Artificial Sequence
  Synthetic polynucleotide
cagcggagtgcggttacggaacccctctacgt

SEQ ID NO: 5086 - DNA, 32 bp, Artificial Sequence
  Synthetic polynucleotide
acagtcagaagaggcgctgcggtatacagatg

SEQ ID NO: 5087 - DNA, 32 bp, Artificial Sequence
  Synthetic polynucleotide
tcgggttcaccgagtaaggcgaacggctcaat

SEQ ID NO: 5088 - DNA, 32 bp, Artificial Sequence
  Synthetic polynucleotide
ttgctcgccgcctctttatcaactggcgcctc

SEQ ID NO: 5089 - DNA, 32 bp, Artificial Sequence
  Synthetic polynucleotide
tagcctaggcacaatttcctaatccgcttaga

SEQ ID NO: 5090 - DNA, 32 bp, Artificial Sequence
  Synthetic polynucleotide
ggccctttcttcgaataaacaatcccgggggt

SEQ ID NO: 5091 - DNA, 32 bp, Artificial Sequence
  Synthetic polynucleotide
gggttgtgcttatttctaagggccggctcgcc

SEQ ID NO: 5092 - DNA, 48 bp, Artificial Sequence; identical to SEQ ID NO: 4445
  Synthetic polynucleotide

SEQ ID NO: 5093 - DNA, 48 bp, Artificial Sequence
  Synthetic polynucleotide
cactgtgaatttccacaccacctccgatgtcagcgccgcatacccatt

SEQ ID NO: 5094 - DNA, 48 bp, Artificial Sequence
  Synthetic polynucleotide
tgtgggaggatcattacaggatcaaagttgactaattcggagcccggc

SEQ ID NO: 5095 - DNA, 48 bp, Artificial Sequence
  Synthetic polynucleotide
ggtatgcattggctcacctcgtgatatcagaggtcgtaactcggtcgc

SEQ ID NO: 5096 - DNA, 48 bp, Artificial Sequence
  Synthetic polynucleotide
tccgcataaggattaacagtgtcatcggtacaaagtccgtgtcggtag

SEQ ID NO: 5097 - DNA, 48 bp, Artificial Sequence; identical to SEQ ID NO: 4452
  Synthetic polynucleotide

SEQ ID NO: 5098 - DNA, 48 bp, Artificial Sequence; identical to SEQ ID NO: 4453
  Synthetic polynucleotide

SEQ ID NO: 5099 - DNA, 48 bp, Artificial Sequence
  Synthetic polynucleotide
gttgtgccccaaagttccagtctgacctctattactcgtcagaataga

SEQ ID NO: 5100 - DNA, 48 bp, Artificial Sequence
  Synthetic polynucleotide
aacgaggtgaatacaaaacctcgaactcgtcctagaaccctgagaggt

SEQ ID NO: 5101 - DNA, 48 bp, Artificial Sequence
  Synthetic polynucleotide
aattttcacatatccccattctacgaaaactacgtgcacaggacggtt

SEQ ID NO: 5102 - DNA, 48 bp, Artificial Sequence
  Synthetic polynucleotide
cctgtaagttgaacgagtagaagaaagcagtcggcaaataataactcc

SEQ ID NO: 5103 - DNA, 48 bp, Artificial Sequence
  Synthetic polynucleotide
attgtgccgcaccctgggcgggctgtaatgcactttgccacgcagaca

SEQ ID NO: 5104 - DNA, 32 bp, Artificial Sequence
  Synthetic polynucleotide
gcggccatgcccagcgcccgacaaggcagcag

SEQ ID NO: 5105 - DNA, 32 bp, Artificial Sequence
  Synthetic polynucleotide
ctcgttcgcgatcgccctgtatgaatctatgt

SEQ ID NO: 5106 - DNA, 32 bp, Artificial Sequence
  Synthetic polynucleotide
gcgccagagcgaaaatattactggcattaaga

SEQ ID NO: 5107 - DNA, 32 bp, Artificial Sequence
  Synthetic polynucleotide
cccatggaccgaacgactcccacagcaaatta

SEQ ID NO: 5108 - DNA, 32 bp, Artificial Sequence
  Synthetic polynucleotide
ccgaattagtcaactttgcataccgaaatact

SEQ ID NO: 5109 - DNA, 32 bp, Artificial Sequence
  Synthetic polynucleotide
attcggatccgtcgatgatcacccaaggagat

SEQ ID NO: 5110 - DNA, 32 bp, Artificial Sequence
  Synthetic polynucleotide
gaattatataagaacaaaactgagtaagacct

SEQ ID NO: 5111 - DNA, 32 bp, Artificial Sequence
  Synthetic polynucleotide
gcccgacgttgttcataactcataggtgcgtc

SEQ ID NO: 5112 - DNA, 32 bp, Artificial Sequence
  Synthetic polynucleotide
aattatcattagggtcacttgattaatgagac

SEQ ID NO: 5113 - DNA, 32 bp, Artificial Sequence
  Synthetic polynucleotide
gccaaaattacgtcttactagcgcttccagta

SEQ ID NO: 5114 - DNA, 32 bp, Artificial Sequence
  Synthetic polynucleotide
ttgttgcggagaacatgatctttcggaccgag

SEQ ID NO: 5115 - DNA, 32 bp, Artificial Sequence
  Synthetic polynucleotide
cgcgagaccacagcactatgcggaaccggata

SEQ ID NO: 5116 - DNA, 32 bp, Artificial Sequence
  Synthetic polynucleotide
acggactttgtaccgactaattacacccccgc

SEQ ID NO: 5117 - DNA, 32 bp, Artificial Sequence
  Synthetic polynucleotide
cgatgtcgaggcggaaaagagtgacatgtagg

SEQ ID NO: 5118 - DNA, 32 bp, Artificial Sequence
  Synthetic polynucleotide
ctcgaattcgccgattagtaaacaatcaagga

SEQ ID NO: 5119 - DNA, 32 bp, Artificial Sequence
  Synthetic polynucleotide
gcttaacacggggcatgccaaggagttaacat

SEQ ID NO: 5120 - DNA, 32 bp, Artificial Sequence
  Synthetic polynucleotide
atgcataagtgtaatgccgtcctctaaaccgg

SEQ ID NO: 5121 - DNA, 32 bp, Artificial Sequence
  Synthetic polynucleotide
cttatcctaaactaaacccaaatgcgccaggg

SEQ ID NO: 5122 - DNA, 32 bp, Artificial Sequence; identical to SEQ ID NO: 4474
  Synthetic polynucleotide

SEQ ID NO: 5123 - DNA, 32 bp, Artificial Sequence; identical to SEQ ID NO: 4475
  Synthetic polynucleotide

SEQ ID NO: 5124 - DNA, 32 bp, Artificial Sequence
  Synthetic polynucleotide
taccctacaatgcccaggcacaactccggttt

SEQ ID NO: 5125 - DNA, 32 bp, Artificial Sequence
  Synthetic polynucleotide
cacgcaaacttacctaggctataggctagggc

SEQ ID NO: 5126 - DNA, 32 bp, Artificial Sequence
  Synthetic polynucleotide
ggcttgcagagcaaggtttgaagatgtcaggg

SEQ ID NO: 5127 - DNA, 32 bp, Artificial Sequence
  Synthetic polynucleotide
gatgaagggcgtcgtcagctccttttcacaca

SEQ ID NO: 5128 - DNA, 32 bp, Artificial Sequence
  Synthetic polynucleotide
gctacgcagtcttagaaactccctacgggccg

SEQ ID NO: 5129 - DNA, 32 bp, Artificial Sequence
  Synthetic polynucleotide
ggcggctacagcgtctgccttagaagtgctga

SEQ ID NO: 5130 - DNA, 32 bp, Artificial Sequence
  Synthetic polynucleotide
aggttgttaggctccgtacagtcattgcaggc

SEQ ID NO: 5131 - DNA, 32 bp, Artificial Sequence
  Synthetic polynucleotide
ttaggttaattgacttacctcgttctatcctg

SEQ ID NO: 5132 - DNA, 32 bp, Artificial Sequence
  Synthetic polynucleotide
gggttctaggacgagttgaaaattacgcacct

SEQ ID NO: 5133 - DNA, 32 bp, Artificial Sequence
  Synthetic polynucleotide
tactccttagggtatcctgactgtcggaaaat

SEQ ID NO: 5134 - DNA, 32 bp, Artificial Sequence
  Synthetic polynucleotide
ctgttcttcagatagactccgctgcgccgaca

SEQ ID NO: 5135 - DNA, 32 bp, Artificial Sequence
  Synthetic polynucleotide
taccactgcgtaaatctggtgcctttgtcggt

SEQ ID NO: 5136 - DNA, 32 bp, Artificial Sequence
  Synthetic polynucleotide
gaatgaaggtcggcagctatagggcagatcct

SEQ ID NO: 5137 - DNA, 32 bp, Artificial Sequence
  Synthetic polynucleotide
cctcggagaggtctgcgcgagcaaatactgca

SEQ ID NO: 5138 - DNA, 32 bp, Artificial Sequence
  Synthetic polynucleotide
atcacttgacgtagaggaacccgaagtagagg

SEQ ID NO: 5139 - DNA, 32 bp, Artificial Sequence
  Synthetic polynucleotide
tgaaccaacatctgtacttacaggccgctagt

SEQ ID NO: 5140 - DNA, 48 bp, Artificial Sequence
  Synthetic polynucleotide
agcacattgatacctacggaagccatcggtacatcggcacaatgcctt

SEQ ID NO: 5141 - DNA, 48 bp, Artificial Sequence
  Synthetic polynucleotide
aaatggaatctaagcggattaggatcacgacctcctgtaaaagaggcg

SEQ ID NO: 5142 - DNA, 48 bp, Artificial Sequence
  Synthetic polynucleotide
agcacaggacccccgggattgtttagccttcggaacgggctactcggt

SEQ ID NO: 5143 - DNA, 48 bp, Artificial Sequence
  Synthetic polynucleotide
tacttcaaggcgagccggcccttatgtctgcgacaatctctcgttcaa

SEQ ID NO: 5144 - DNA, 32 bp, Artificial Sequence; identical to SEQ ID NO: 9
  Synthetic polynucleotide

SEQ ID NO: 5145 - DNA, 32 bp, Artificial Sequence; identical to SEQ ID NO: 28
  Synthetic polynucleotide

SEQ ID NO: 5146 - DNA, 32 bp, Artificial Sequence; identical to SEQ ID NO: 47
  Synthetic polynucleotide

SEQ ID NO: 5147 - DNA, 32 bp, Artificial Sequence; identical to SEQ ID NO: 418
  Synthetic polynucleotide

SEQ ID NO: 5148 - DNA, 32 bp, Artificial Sequence; identical to SEQ ID NO: 430
  Synthetic polynucleotide

SEQ ID NO: 5149 - DNA, 32 bp, Artificial Sequence; identical to SEQ ID NO: 2011
  Synthetic polynucleotide

SEQ ID NO: 5150 - DNA, 32 bp, Artificial Sequence; identical to SEQ ID NO: 1016
  Synthetic polynucleotide

SEQ ID NO: 5151 - DNA, 32 bp, Artificial Sequence; identical to SEQ ID NO: 4484
  Synthetic polynucleotide

SEQ ID NO: 5152 - DNA, 32 bp, Artificial Sequence; identical to SEQ ID NO: 4174
  Synthetic polynucleotide

SEQ ID NO: 5153 - DNA, 32 bp, Artificial Sequence; identical to SEQ ID NO: 2095
  Synthetic polynucleotide

SEQ ID NO: 5154 - DNA, 32 bp, Artificial Sequence; identical to SEQ ID NO: 4487
  Synthetic polynucleotide

SEQ ID NO: 5155 - DNA, 32 bp, Artificial Sequence; identical to SEQ ID NO: 1246
  Synthetic polynucleotide

SEQ ID NO: 5156 - DNA, 32 bp, Artificial Sequence; identical to SEQ ID NO: 3536
  Synthetic polynucleotide

SEQ ID NO: 5157 - DNA, 32 bp, Artificial Sequence; identical to SEQ ID NO: 4176
  Synthetic polynucleotide

SEQ ID NO: 5158 - DNA, 32 bp, Artificial Sequence; identical to SEQ ID NO: 4490
  Synthetic polynucleotide

SEQ ID NO: 5159 - DNA, 32 bp, Artificial Sequence; identical to SEQ ID NO: 4491
  Synthetic polynucleotide

SEQ ID NO: 5160 - DNA, 32 bp, Artificial Sequence; identical to SEQ ID NO: 3665
  Synthetic polynucleotide

SEQ ID NO: 5161 - DNA, 32 bp, Artificial Sequence; identical to SEQ ID NO: 3216
  Synthetic polynucleotide

SEQ ID NO: 5162 - DNA, 32 bp, Artificial Sequence
  Synthetic polynucleotide
tccgccacccctgacatagccgccttggggga

SEQ ID NO: 5163 - DNA, 32 bp, Artificial Sequence; identical to SEQ ID NO: 3694
  Synthetic polynucleotide

SEQ ID NO: 5164 - DNA, 32 bp, Artificial Sequence
  Synthetic polynucleotide
ccaccgggcaggatagaaggagtacagagtac

SEQ ID NO: 5165 - DNA, 32 bp, Artificial Sequence; identical to SEQ ID NO: 4179
  Synthetic polynucleotide

SEQ ID NO: 5166 - DNA, 32 bp, Artificial Sequence
  Synthetic polynucleotide
ttcggctctcagcactcagtggtacttgagca

SEQ ID NO: 5167 - DNA, 32 bp, Artificial Sequence
  Synthetic polynucleotide
tgagcgcgtgtcggcgctccgaggcaacaaca

SEQ ID NO: 5168 - DNA, 32 bp, Artificial Sequence
  Synthetic polynucleotide
accgcgtgattttccgcaagtgatagacgaga

SEQ ID NO: 5169 - DNA, 32 bp, Artificial Sequence
  Synthetic polynucleotide
caaggcggactagcgggttcactagaacgacc

SEQ ID NO: 5170 - DNA, 32 bp, Artificial Sequence
  Synthetic polynucleotide
tggaacatcctctacttgtccgcatcatagga

SEQ ID NO: 5171 - DNA, 32 bp, Artificial Sequence; identical to SEQ ID NO: 1712
  Synthetic polynucleotide

SEQ ID NO: 5172 - DNA, 32 bp, Artificial Sequence
  Synthetic polynucleotide
gtttatacgtctagctttccattttatgcagg

SEQ ID NO: 5173 - DNA, 32 bp, Artificial Sequence
  Synthetic polynucleotide
cagcgcaaaagcgccccctgtgctattctgca

SEQ ID NO: 5174 - DNA, 48 bp, Artificial Sequence
  Synthetic polynucleotide
tgctacatcagtttcttgtgcacgtcagggattctcaccggtggccgt

SEQ ID NO: 5175 - DNA, 48 bp, Artificial Sequence
  Synthetic polynucleotide
cctgggtcctgctgccttgtcgggacctgtcattggagtgatgaacaa

SEQ ID NO: 5176 - DNA, 48 bp, Artificial Sequence; identical to SEQ ID NO: 2998
  Synthetic polynucleotide

SEQ ID NO: 5177 - DNA, 48 bp, Artificial Sequence
  Synthetic polynucleotide
cagcatgcccggtttagaggacggtaaccaaaagggcactgacgacgc

SEQ ID NO: 5178 - DNA, 48 bp, Artificial Sequence
  Synthetic polynucleotide
caaagtgacggcccgtagggagttcccggcgagctgtttggatttacg

SEQ ID NO: 5179 - DNA, 48 bp, Artificial Sequence
  Synthetic polynucleotide
tcacatagaggatctgccctatagaaggcatttcctatgcaccgaatc

SEQ ID NO: 5180 - DNA, 48 bp, Artificial Sequence
  Synthetic polynucleotide
ggataagggattcggtctaggctagatgatctagctgcgtaacgtctt

SEQ ID NO: 5181 - DNA, 48 bp, Artificial Sequence
  Synthetic polynucleotide
tgcggacagaggcgccaaagggccagctagacgtataaactgaagact

SEQ ID NO: 5182 - DNA, 48 bp, Artificial Sequence
  Synthetic polynucleotide
tagtgaacattgagcccacaacccgggcgcttttgcgctggcaaaggg

SEQ ID NO: 5183 - DNA, 48 bp, Artificial Sequence
  Synthetic polynucleotide
tatttgccgactgcttggcacaatctgacgaccatgatccttcgcggc

SEQ ID NO: 5184 - DNA, 48 bp, Artificial Sequence
  Synthetic polynucleotide
tgcattccaatgtttgatggccgcgtggcttattacatgtgcaagtga

SEQ ID NO: 5185 - DNA, 48 bp, Artificial Sequence
  Synthetic polynucleotide
gaatgagcgacgcacctgataattaacactccgagtccccgaagaata

SEQ ID NO: 5186 - DNA, 48 bp, Artificial Sequence
  Synthetic polynucleotide
cgcgttagatgttaacttatgcattgcggtactcagtgattccagagc

SEQ ID NO: 5187 - DNA, 48 bp, Artificial Sequence
  Synthetic polynucleotide
gtcgcacttgtgtgaatgcgtagcatgcaccgtacctttacacccaga

SEQ ID NO: 5188 - DNA, 48 bp, Artificial Sequence
  Synthetic polynucleotide
agcggctcaccgacaacttcattccacggagactgaaaacggaaacat

SEQ ID NO: 5189 - DNA, 48 bp, Artificial Sequence
  Synthetic polynucleotide
acgcagctagatcatcaatgtgctcgagccagagtttaagttatgggc

SEQ ID NO: 5190 - DNA, 32 bp, Artificial Sequence
  Synthetic polynucleotide
tgttttcggccgggcttcctcggtagggtgta

SEQ ID NO: 5191 - DNA, 32 bp, Artificial Sequence
  Synthetic polynucleotide
gccgatggcgtaccttgcctggccctacttca

SEQ ID NO: 5192 - DNA, 32 bp, Artificial Sequence
  Synthetic polynucleotide
tggtcggtcacaggatcgaatcgcaggagatc

SEQ ID NO: 5193 - DNA, 32 bp, Artificial Sequence
  Synthetic polynucleotide
gcgcgggccgaaggtcggaatgcaacaccggc

SEQ ID NO: 5194 - DNA, 32 bp, Artificial Sequence
  Synthetic polynucleotide
ggggactcggagtgttgacccagggtgaaccc

SEQ ID NO: 5195 - DNA, 32 bp, Artificial Sequence
  Synthetic polynucleotide
gcgacgctcccgttcctaacagcaggtcggcc

SEQ ID NO: 5196 - DNA, 32 bp, Artificial Sequence
  Synthetic polynucleotide
gcggatgctttgcattggtagaaggaactctg

SEQ ID NO: 5197 - DNA, 32 bp, Artificial Sequence
  Synthetic polynucleotide
tcggcagctagcgtctttctgctagtacaaat

SEQ ID NO: 5198 - DNA, 32 bp, Artificial Sequence
  Synthetic polynucleotide
atggattgctaccgacagacgtttcctcacgc

SEQ ID NO: 5199 - DNA, 32 bp, Artificial Sequence
  Synthetic polynucleotide
cctaacattgaacggtcgatagaaacaatttc

SEQ ID NO: 5200 - DNA, 32 bp, Artificial Sequence
  Synthetic polynucleotide
aagccactgggacatggaagaggtcaaggacg

SEQ ID NO: 5201 - DNA, 32 bp, Artificial Sequence
  Synthetic polynucleotide
cctatcacttatttacgctcattcgcctacct

SEQ ID NO: 5202 - DNA, 32 bp, Artificial Sequence
  Synthetic polynucleotide
atcactgagtaccgcaacgttgttacggctag

SEQ ID NO: 5203 - DNA, 32 bp, Artificial Sequence
  Synthetic polynucleotide
tcgctttagtcactgctacaggtgcctttcac

SEQ ID NO: 5204 - DNA, 32 bp, Artificial Sequence
  Synthetic polynucleotide
atggttatacgggtacaatgagcttgggatct

SEQ ID NO: 5205 - DNA, 32 bp, Artificial Sequence
  Synthetic polynucleotide
tcgagtctagctaccgaccctggccgagtgga

SEQ ID NO: 5206 - DNA, 32 bp, Artificial Sequence; identical to SEQ ID NO: 4525
  Synthetic polynucleotide

SEQ ID NO: 5207 - DNA, 32 bp, Artificial Sequence; identical to SEQ ID NO: 4526
  Synthetic polynucleotide

SEQ ID NO: 5208 - DNA, 32 bp, Artificial Sequence
  Synthetic polynucleotide
ttggggcgcaggtgagaactgcgcagtaccca

SEQ ID NO: 5209 - DNA, 32 bp, Artificial Sequence
  Synthetic polynucleotide
tagcgcacaagtccgtctaacgcgcaccaggt

SEQ ID NO: 5210 - DNA, 32 bp, Artificial Sequence
  Synthetic polynucleotide
taaaggtacggtgcatgcatgctgtatgccta

SEQ ID NO: 5211 - DNA, 32 bp, Artificial Sequence
  Synthetic polynucleotide
ccgtcctatcccccaataggtatgtgcatatt

SEQ ID NO: 5212 - DNA, 32 bp, Artificial Sequence
  Synthetic polynucleotide
ttccgcgctattgctgactacttaagacttag

SEQ ID NO: 5213 - DNA, 32 bp, Artificial Sequence
  Synthetic polynucleotide
acaacaattttcctttaggtagtcttagcagg

SEQ ID NO: 5214 - DNA, 32 bp, Artificial Sequence
  Synthetic polynucleotide
aaaagtagacctctcaccagcatcgagacaga

SEQ ID NO: 5215 - DNA, 32 bp, Artificial Sequence
  Synthetic polynucleotide
aaagcgaggtactctgtgtatggtgccttatg

SEQ ID NO: 5216 - DNA, 32 bp, Artificial Sequence
  Synthetic polynucleotide
atggagctgcacggaagtggcggacgtctatt

SEQ ID NO: 5217 - DNA, 32 bp, Artificial Sequence
  Synthetic polynucleotide
acagccggtgctcaagagtgcgactttcactg

SEQ ID NO: 5218 - DNA, 32 bp, Artificial Sequence
  Synthetic polynucleotide
gttttcagtctccgtgtcactttgaaaagcgc

SEQ ID NO: 5219 - DNA, 32 bp, Artificial Sequence
  Synthetic polynucleotide
tgctggcttgttgttggagccgaaaattcttc

SEQ ID NO: 5220 - DNA, 32 bp, Artificial Sequence
  Synthetic polynucleotide
cgtaaagctctcgtctcctggttgaggcgtaa

SEQ ID NO: 5221 - DNA, 32 bp, Artificial Sequence
  Synthetic polynucleotide
agcgcgagtctatatccccggtgggaggagca

SEQ ID NO: 5222 - DNA, 32 bp, Artificial Sequence
  Synthetic polynucleotide
tccatgtgggagttatttggcgctggatagtg

SEQ ID NO: 5223 - DNA, 32 bp, Artificial Sequence
  Synthetic polynucleotide
gagattgaggtcgttccacgcggtggctccgt

SEQ ID NO: 5224 - DNA, 32 bp, Artificial Sequence
  Synthetic polynucleotide
ccactaagtcctatgacgcgctcaggccgggg

SEQ ID NO: 5225 - DNA, 32 bp, Artificial Sequence
  Synthetic polynucleotide
gtcggtttctgaaacagagccgctcacagagg

SEQ ID NO: 5226 - DNA, 48 bp, Artificial Sequence
  Synthetic polynucleotide
gtattagcaaccgtgagtatgattgcggccattcacagtgcctgcgaa

SEQ ID NO: 5227 - DNA, 48 bp, Artificial Sequence
  Synthetic polynucleotide
aaagcttctggtgaatgcaccgaaaaaagcccgggctgatcccgcaac

SEQ ID NO: 5228 - DNA, 48 bp, Artificial Sequence
  Synthetic polynucleotide
attaccgttaagcgttacaggcggaggatatgcactcgcacttagatc

SEQ ID NO: 5229 - DNA, 48 bp, Artificial Sequence
  Synthetic polynucleotide
cggcatgcgtcctcacgcgggccgggaaggacctttaggcccaaggag

SEQ ID NO: 5230 - DNA, 48 bp, Artificial Sequence
  Synthetic polynucleotide
gtattactgaagcgtaatcgactatatcccaaccccaagtgctacatg

SEQ ID NO: 5231 - DNA, 48 bp, Artificial Sequence
  Synthetic polynucleotide
atgtggttaggacgatagattgtagctgtgaccctatcttacgcttac

SEQ ID NO: 5232 - DNA, 48 bp, Artificial Sequence
  Synthetic polynucleotide
agtatagtcgcagggtgctatgctacggccacggcggtaccaaacatt

SEQ ID NO: 5233 - DNA, 48 bp, Artificial Sequence
  Synthetic polynucleotide
acatgtaataagccacatgtagcattccccaggagtgcaactaatccc

SEQ ID NO: 5234 - DNA, 32 bp, Artificial Sequence; identical to SEQ ID NO: 4534
  Synthetic polynucleotide

SEQ ID NO: 5235 - DNA, 32 bp, Artificial Sequence; identical to SEQ ID NO: 48
  Synthetic polynucleotide

SEQ ID NO: 5236 - DNA, 32 bp, Artificial Sequence; identical to SEQ ID NO: 4536
  Synthetic polynucleotide

SEQ ID NO: 5237 - DNA, 32 bp, Artificial Sequence; identical to SEQ ID NO: 416
  Synthetic polynucleotide

SEQ ID NO: 5238 - DNA, 32 bp, Artificial Sequence; identical to SEQ ID NO: 432
  Synthetic polynucleotide

SEQ ID NO: 5239 - DNA, 32 bp, Artificial Sequence; identical to SEQ ID NO: 3355
  Synthetic polynucleotide

SEQ ID NO: 5240 - DNA, 32 bp, Artificial Sequence; identical to SEQ ID NO: 3547
  Synthetic polynucleotide

SEQ ID NO: 5241 - DNA, 32 bp, Artificial Sequence
  Synthetic polynucleotide
atgcggagaggtaggcagcgtcgcttaaagtg

SEQ ID NO: 5242 - DNA, 32 bp, Artificial Sequence; identical to SEQ ID NO: 4540
  Synthetic polynucleotide

SEQ ID NO: 5243 - DNA, 32 bp, Artificial Sequence; identical to SEQ ID NO: 2096
  Synthetic polynucleotide

SEQ ID NO: 5244 - DNA, 32 bp, Artificial Sequence
  Synthetic polynucleotide
cgacctctagatcccaatgttaggagctaaca

SEQ ID NO: 5245 - DNA, 32 bp, Artificial Sequence; identical to SEQ ID NO: 3731
  Synthetic polynucleotide

SEQ ID NO: 5246 - DNA, 32 bp, Artificial Sequence; identical to SEQ ID NO: 3732
  Synthetic polynucleotide

SEQ ID NO: 5247 - DNA, 32 bp, Artificial Sequence; identical to SEQ ID NO: 4544
  Synthetic polynucleotide

SEQ ID NO: 5248 - DNA, 32 bp, Artificial Sequence; identical to SEQ ID NO: 4545
  Synthetic polynucleotide

SEQ ID NO: 5249 - DNA, 32 bp, Artificial Sequence; identical to SEQ ID NO: 3356
  Synthetic polynucleotide

SEQ ID NO: 5250 - DNA, 32 bp, Artificial Sequence; identical to SEQ ID NO: 3548
  Synthetic polynucleotide

SEQ ID NO: 5251 - DNA, 32 bp, Artificial Sequence; identical to SEQ ID NO: 4548
  Synthetic polynucleotide

SEQ ID NO: 5252 - DNA, 32 bp, Artificial Sequence
  Synthetic polynucleotide
gcacgttaaatagacggcgcggaagacctccg

SEQ ID NO: 5253 - DNA, 32 bp, Artificial Sequence; identical to SEQ ID NO: 3734
  Synthetic polynucleotide

SEQ ID NO: 5254 - DNA, 32 bp, Artificial Sequence; identical to SEQ ID NO: 1588
  Synthetic polynucleotide

SEQ ID NO: 5255 - DNA, 32 bp, Artificial Sequence
  Synthetic polynucleotide
tttcaaaagaagaattagctccatttagaatc

SEQ ID NO: 5256 - DNA, 32 bp, Artificial Sequence
  Synthetic polynucleotide
acggtcttcctctgtgagccagcacgctcttg

SEQ ID NO: 5257 - DNA, 32 bp, Artificial Sequence
  Synthetic polynucleotide
ttctaatgccccggccgctttacgacgtgacc

SEQ ID NO: 5258 - DNA, 32 bp, Artificial Sequence
  Synthetic polynucleotide
gatataatacggagccctcgcgctgctccgat

SEQ ID NO: 5259 - DNA, 32 bp, Artificial Sequence
  Synthetic polynucleotide
acgcatattgcgaaggtcaatctctcgctatg

SEQ ID NO: 5260 - DNA, 32 bp, Artificial Sequence
  Synthetic polynucleotide
cgcatagttttcatcccttagtggtcatcgtg

SEQ ID NO: 5261 - DNA, 32 bp, Artificial Sequence
  Synthetic polynucleotide
gggggagtaagacgttgtaacctaatatttat

SEQ ID NO: 5262 - DNA, 32 bp, Artificial Sequence
  Synthetic polynucleotide
cgcaaacaagtcttcagatcggtcgtgacccg

SEQ ID NO: 5263 - DNA, 32 bp, Artificial Sequence
  Synthetic polynucleotide
acccagcaccctttgccgaggcatatataggt

SEQ ID NO: 5264 - DNA, 48 bp, Artificial Sequence; identical to SEQ ID NO: 4549
  Synthetic polynucleotide

SEQ ID NO: 5265 - DNA, 48 bp, Artificial Sequence
  Synthetic polynucleotide
agctcgtatacaccctaccgaggattcgcaggtccatgggattcacca

SEQ ID NO: 5266 - DNA, 48 bp, Artificial Sequence
  Synthetic polynucleotide
caattactatttgtaccgaaaacaagggcatagtattatcgcgtcaat

SEQ ID NO: 5267 - DNA, 48 bp, Artificial Sequence
  Synthetic polynucleotide
tagactcagcgtgaggaaacgtctagtatttcgtctcgcgagacgcta

SEQ ID NO: 5268 - DNA, 48 bp, Artificial Sequence
  Synthetic polynucleotide
cgtaatgttccactcgcaatccattacggacagcgatggtgatgggaa

SEQ ID NO: 5269 - DNA, 48 bp, Artificial Sequence; identical to SEQ ID NO: 4556
  Synthetic polynucleotide

SEQ ID NO: 5270 - DNA, 48 bp, Artificial Sequence; identical to SEQ ID NO: 4557
  Synthetic polynucleotide

SEQ ID NO: 5271 - DNA, 48 bp, Artificial Sequence
  Synthetic polynucleotide
gcagtgtgtctgtctcgatgctggaaaccggataacctaaaaaggaaa

SEQ ID NO: 5272 - DNA, 48 bp, Artificial Sequence
  Synthetic polynucleotide
aagcggtctgctcctcctacttttgacgtcagttatgtctcaggcgta

SEQ ID NO: 5273 - DNA, 48 bp, Artificial Sequence
  Synthetic polynucleotide
agaacttgcactatccagcgccaaaggtgcgtttggttcagatataga

SEQ ID NO: 5274 - DNA, 48 bp, Artificial Sequence
  Synthetic polynucleotide
aatgaggaaggcgattcacatggattactcgttgactcggtcgagaac

SEQ ID NO: 5275 - DNA, 48 bp, Artificial Sequence
  Synthetic polynucleotide
ctagcttggccgcgaaggatcatggtcgtcagttgaagtataccgaac

SEQ ID NO: 5276 - DNA, 32 bp, Artificial Sequence
  Synthetic polynucleotide
ttccgcgttcacttgccaaagggcggcactag

SEQ ID NO: 5277 - DNA, 32 bp, Artificial Sequence
  Synthetic polynucleotide
gcgttaaaacgactttccaccttattacgagt

SEQ ID NO: 5278 - DNA, 32 bp, Artificial Sequence
  Synthetic polynucleotide
agcaggtcggtgctaccttccatgtaattata

SEQ ID NO: 5279 - DNA, 32 bp, Artificial Sequence
  Synthetic polynucleotide
accgaagcggctagaaagtaattgtcgctttt

SEQ ID NO: 5280 - DNA, 32 bp, Artificial Sequence
  Synthetic polynucleotide
gataatactatgcccttgagtctaggggatga

SEQ ID NO: 5281 - DNA, 32 bp, Artificial Sequence
  Synthetic polynucleotide
tggctcgttcaattttaacatggtatcgctga

SEQ ID NO: 5282 - DNA, 32 bp, Artificial Sequence
  Synthetic polynucleotide
aatgttcttagcgcctcgatgcttttgccaca

SEQ ID NO: 5283 - DNA, 32 bp, Artificial Sequence
  Synthetic polynucleotide
gatatcgctaggttatctccgcatcatgttgt

SEQ ID NO: 5284 - DNA, 32 bp, Artificial Sequence
  Synthetic polynucleotide
actgtagttattcttcttatgtcgggcctcag

SEQ ID NO: 5285 - DNA, 32 bp, Artificial Sequence
  Synthetic polynucleotide
atattgtacactttaaaactgccgaccagttt

SEQ ID NO: 5286 - DNA, 32 bp, Artificial Sequence
  Synthetic polynucleotide
tagatgcgccatgcgaagaggtcgaggcgagt

SEQ ID NO: 5287 - DNA, 32 bp, Artificial Sequence
  Synthetic polynucleotide
ttttaacagcctcgtgacattacgtacactcg

SEQ ID NO: 5288 - DNA, 32 bp, Artificial Sequence
  Synthetic polynucleotide
accatcgctgtccgtacctaccctccagcgta

SEQ ID NO: 5289 - DNA, 32 bp, Artificial Sequence
  Synthetic polynucleotide
cgtgtcgatgttagctttcctgggcgcaagct

SEQ ID NO: 5290 - DNA, 32 bp, Artificial Sequence
  Synthetic polynucleotide
acggaaaccacctaggatattacacccttccc

SEQ ID NO: 5291 - DNA, 32 bp, Artificial Sequence
  Synthetic polynucleotide
tataccaagctgagagtatcggtttttcatag

SEQ ID NO: 5292 - DNA, 32 bp, Artificial Sequence
  Synthetic polynucleotide
agtgcgccgctctggataggaatgaactgcac

SEQ ID NO: 5293 - DNA, 32 bp, Artificial Sequence
  Synthetic polynucleotide
cctacgccgtcgttacacttgatgccaagcat

SEQ ID NO: 5294 - DNA, 32 bp, Artificial Sequence; identical to SEQ ID NO: 4578
  Synthetic polynucleotide

SEQ ID NO: 5295 - DNA, 32 bp, Artificial Sequence; identical to SEQ ID NO: 4579
  Synthetic polynucleotide

SEQ ID NO: 5296 - DNA, 32 bp, Artificial Sequence
  Synthetic polynucleotide
agggcaactaaccctgcacactgcgtggttcg

SEQ ID NO: 5297 - DNA, 32 bp, Artificial Sequence
  Synthetic polynucleotide
cgcgaaggcctaaggtggccactgccgccaca

SEQ ID NO: 5298 - DNA, 32 bp, Artificial Sequence
  Synthetic polynucleotide
gtaggctcaggagcagtaacgtgcctgatcac

SEQ ID NO: 5299 - DNA, 32 bp, Artificial Sequence
  Synthetic polynucleotide
cgattggtaataccttttgtcaagactagctc

SEQ ID NO: 5300 - DNA, 32 bp, Artificial Sequence
  Synthetic polynucleotide
atattagctctgggtgtcacgggcgaatcgcg

SEQ ID NO: 5301 - DNA, 32 bp, Artificial Sequence
  Synthetic polynucleotide
tcaataatttttatagttttgaaacgagcaac

SEQ ID NO: 5302 - DNA, 32 bp, Artificial Sequence
  Synthetic polynucleotide
tgaggtcgcggaggtcctttagtcccttacgt

SEQ ID NO: 5303 - DNA, 32 bp, Artificial Sequence
  Synthetic polynucleotide
gcccgcggtaatcgctgaccgcttcttctgtc

SEQ ID NO: 5304 - DNA, 32 bp, Artificial Sequence
  Synthetic polynucleotide
agacataactgacgtccaagttctaattgaat

SEQ ID NO: 5305 - DNA, 32 bp, Artificial Sequence
  Synthetic polynucleotide
tggcccttaagagcaaattatatcctaagaac

SEQ ID NO: 5306 - DNA, 32 bp, Artificial Sequence
  Synthetic polynucleotide
atttttgtgattctaacattagaaggcaagta

SEQ ID NO: 5307 - DNA, 32 bp, Artificial Sequence
  Synthetic polynucleotide
cgaagctgccgtcgtaaagaccgtagttatgg

SEQ ID NO: 5308 - DNA, 32 bp, Artificial Sequence
  Synthetic polynucleotide
gtagccacatgtttcccgggctagggatgtag

SEQ ID NO: 5309 - DNA, 32 bp, Artificial Sequence
  Synthetic polynucleotide
ccgaaaatcaagagcgactatgcgggtatatg

SEQ ID NO: 5310 - DNA, 32 bp, Artificial Sequence
  Synthetic polynucleotide
gacactgaggtcacgtatatgcgtcatacttc

SEQ ID NO: 5311 - DNA, 32 bp, Artificial Sequence
  Synthetic polynucleotide
tggttgatatcggagctcctcattaatatggt

SEQ ID NO: 5312 - DNA, 48 bp, Artificial Sequence
  Synthetic polynucleotide
cactcgctgcccataacttaaactctggctcgctatgtgagaagctcc

SEQ ID NO: 5313 - DNA, 48 bp, Artificial Sequence
  Synthetic polynucleotide
gggtaggcttatgcgaactcccccgtttgccgcccgtgtgatgatagt

SEQ ID NO: 5314 - DNA, 48 bp, Artificial Sequence
  Synthetic polynucleotide
ccggtaacataaatattaggttaccctgcatagcctcccgggatgaaa

SEQ ID NO: 5315 - DNA, 48 bp, Artificial Sequence
  Synthetic polynucleotide
aaccgtgacacgatgatgtttgcgccttaaaatcgtccgcgggaaaca

SEQ ID NO: 5316 - DNA, 48 bp, Artificial Sequence
  Synthetic polynucleotide
aacgccaccgggtcacgaccgatctgcagaatatgttccaccttcgca

SEQ ID NO: 5317 - DNA, 48 bp, Artificial Sequence
  Synthetic polynucleotide
catgagtgcatagcgatgctgggtttgtttgcgggtttatgaactacc

SEQ ID NO: 5318 - DNA, 48 bp, Artificial Sequence
  Synthetic polynucleotide
tcgtattcacctatatatgcctcggttcggtaccgccttgaatcgcct

SEQ ID NO: 5319 - DNA, 48 bp, Artificial Sequence
  Synthetic polynucleotide
ccgagtcaacgagtaacaagctagaattgtgtgcctgtcgcactctta

SEQ ID NO: 5320 - DNA, 32 bp, Artificial Sequence; identical to SEQ ID NO: 11
  Synthetic polynucleotide

SEQ ID NO: 5321 - DNA, 32 bp, Artificial Sequence; identical to SEQ ID NO: 31
  Synthetic polynucleotide

SEQ ID NO: 5322 - DNA, 32 bp, Artificial Sequence; identical to SEQ ID NO: 49
  Synthetic polynucleotide

SEQ ID NO: 5323 - DNA, 32 bp, Artificial Sequence; identical to SEQ ID NO: 419
  Synthetic polynucleotide

SEQ ID NO: 5324 - DNA, 32 bp, Artificial Sequence; identical to SEQ ID NO: 1984
  Synthetic polynucleotide

SEQ ID NO: 5325 - DNA, 32 bp, Artificial Sequence; identical to SEQ ID NO: 2013
  Synthetic polynucleotide

SEQ ID NO: 5326 - DNA, 32 bp, Artificial Sequence; identical to SEQ ID NO: 2026
  Synthetic polynucleotide

SEQ ID NO: 5327 - DNA, 32 bp, Artificial Sequence; identical to SEQ ID NO: 4591
  Synthetic polynucleotide

SEQ ID NO: 5328 - DNA, 32 bp, Artificial Sequence; identical to SEQ ID NO: 4593
  Synthetic polynucleotide

SEQ ID NO: 5329 - DNA, 32 bp, Artificial Sequence; identical to SEQ ID NO: 2097
  Synthetic polynucleotide

SEQ ID NO: 5330 - DNA, 32 bp, Artificial Sequence; identical to SEQ ID NO: 4594
  Synthetic polynucleotide

SEQ ID NO: 5331 - DNA, 32 bp, Artificial Sequence; identical to SEQ ID NO: 1248
  Synthetic polynucleotide

SEQ ID NO: 5332 - DNA, 32 bp, Artificial Sequence; identical to SEQ ID NO: 3560
  Synthetic polynucleotide

SEQ ID NO: 5333 - DNA, 32 bp, Artificial Sequence
  Synthetic polynucleotide
aacgggatgggaagggggcgtaggggccgcac

SEQ ID NO: 5334 - DNA, 32 bp, Artificial Sequence; identical to SEQ ID NO: 4597
  Synthetic polynucleotide

SEQ ID NO: 5335 - DNA, 32 bp, Artificial Sequence; identical to SEQ ID NO: 3757
  Synthetic polynucleotide

SEQ ID NO: 5336 - DNA, 32 bp, Artificial Sequence; identical to SEQ ID NO: 4599
  Synthetic polynucleotide

SEQ ID NO: 5337 - DNA, 32 bp, Artificial Sequence; identical to SEQ ID NO: 3758
  Synthetic polynucleotide

SEQ ID NO: 5338 - DNA, 32 bp, Artificial Sequence; identical to SEQ ID NO: 4805
  Synthetic polynucleotide

SEQ ID NO: 5339 - DNA, 32 bp, Artificial Sequence; identical to SEQ ID NO: 4190
  Synthetic polynucleotide

SEQ ID NO: 5340 - DNA, 32 bp, Artificial Sequence; identical to SEQ ID NO: 3759
  Synthetic polynucleotide

SEQ ID NO: 5341 - DNA, 32 bp, Artificial Sequence
  Synthetic polynucleotide
cgcttttaacgtaaggacaaaaattggacgta

SEQ ID NO: 5342 - DNA, 32 bp, Artificial Sequence
  Synthetic polynucleotide
gccatactgttgctcgcagcttcgaaattgca

SEQ ID NO: 5343 - DNA, 32 bp, Artificial Sequence
  Synthetic polynucleotide
cagacgcgtacttgccattttcgggtagaagt

SEQ ID NO: 5344 - DNA, 32 bp, Artificial Sequence
  Synthetic polynucleotide
ggccattggttcttagtcagtgtctcaggggc

SEQ ID NO: 5345 - DNA, 32 bp, Artificial Sequence; identical to SEQ ID NO: 1686
  Synthetic polynucleotide

SEQ ID NO: 5346 - DNA, 32 bp, Artificial Sequence
  Synthetic polynucleotide
gtgatcatgaagtatgtcacggttccaaatga

SEQ ID NO: 5347 - DNA, 32 bp, Artificial Sequence
  Synthetic polynucleotide
aacggagacatataccgcctacccggctcaag

SEQ ID NO: 5348 - DNA, 32 bp, Artificial Sequence
  Synthetic polynucleotide
gcggacgattttaagggttaccggcggcggat

SEQ ID NO: 5349 - DNA, 32 bp, Artificial Sequence
  Synthetic polynucleotide
ataaacccgcaaacaagtggcgtttgcagccc

SEQ ID NO: 5350 - DNA, 48 bp, Artificial Sequence
  Synthetic polynucleotide
ggtttggagggattagttgcactcctggggaaactatacttacgcact

SEQ ID NO: 5351 - DNA, 48 bp, Artificial Sequence
  Synthetic polynucleotide
ccgcctccggtagtcaacgcggaacgtaatggaatatatgacttggtc

SEQ ID NO: 5352 - DNA, 48 bp, Artificial Sequence
  Synthetic polynucleotide
agtaatgtctagtgccgccctttggggttcacgcccgcgcataaccta

SEQ ID NO: 5353 - DNA, 48 bp, Artificial Sequence
  Synthetic polynucleotide
tgtccaagacaacatgactacagttgaccgggggatattctccgccgg

SEQ ID NO: 5354 - DNA, 48 bp, Artificial Sequence; identical to SEQ ID NO: 3010
  Synthetic polynucleotide

SEQ ID NO: 5355 - DNA, 48 bp, Artificial Sequence
  Synthetic polynucleotide
gaccaactctatgaaaggcgcacttaattctggttaacacagcggagt

SEQ ID NO: 5356 - DNA, 48 bp, Artificial Sequence
  Synthetic polynucleotide
taatcgccgtgcagttcattcctataggcatagtgcgctaaaggtatt

SEQ ID NO: 5357 - DNA, 48 bp, Artificial Sequence
  Synthetic polynucleotide
actcaaccgagctagtgctaatatcctctaagtctagcctatgccgaa

SEQ ID NO: 5358 - DNA, 48 bp, Artificial Sequence
  Synthetic polynucleotide
gtcacatgcgcgattcgcccgtgagcgcttttccggctgttacgacgg

SEQ ID NO: 5359 - DNA, 48 bp, Artificial Sequence
  Synthetic polynucleotide
tacgccacccataactgtggctacaacggcgcggcttatgtgtcgctt

SEQ ID NO: 5360 - DNA, 48 bp, Artificial Sequence
  Synthetic polynucleotide
tgttcatcctacatccctagcccgggagcttcaaaccgactcgcataa

SEQ ID NO: 5361 - DNA, 48 bp, Artificial Sequence
  Synthetic polynucleotide
cacacgggcggcaaacagcgagtgctgaaatgatttttatagaacgat

SEQ ID NO: 5362 - DNA, 32 bp, Artificial Sequence
  Synthetic polynucleotide
cgggtgtcattgacgcggagaatcggtgatct

SEQ ID NO: 5363 - DNA, 32 bp, Artificial Sequence
  Synthetic polynucleotide
cctaggcgctaggtgggatgctattccagaat

SEQ ID NO: 5364 - DNA, 32 bp, Artificial Sequence
  Synthetic polynucleotide
ggtattttcgaacccgtatttgacgtcttgcg

SEQ ID NO: 5365 - DNA, 32 bp, Artificial Sequence
  Synthetic polynucleotide
tttacgctcgcattcaggaggcgggggtatag

SEQ ID NO: 5366 - DNA, 32 bp, Artificial Sequence
  Synthetic polynucleotide
gaatatcccccggtcaacattacttgactctt

SEQ ID NO: 5367 - DNA, 32 bp, Artificial Sequence
  Synthetic polynucleotide
cggcgccgatataactataccctattgtcgtt

SEQ ID NO: 5368 - DNA, 32 bp, Artificial Sequence
  Synthetic polynucleotide
ggcggatattgctagggcggtaacatcacata

SEQ ID NO: 5369 - DNA, 32 bp, Artificial Sequence
  Synthetic polynucleotide
caacacaacctgtgggcgttactgaccctaac

SEQ ID NO: 5370 - DNA, 32 bp, Artificial Sequence
  Synthetic polynucleotide
cttggcttttcccatcggcccatacatacatg

SEQ ID NO: 5371 - DNA, 32 bp, Artificial Sequence
  Synthetic polynucleotide
cacctacctctatcaccgccgtgttgttctac

SEQ ID NO: 5372 - DNA, 32 bp, Artificial Sequence
  Synthetic polynucleotide
cagccttcaagaacgccatcttaacgaccgtt

SEQ ID NO: 5373 - DNA, 32 bp, Artificial Sequence
  Synthetic polynucleotide
acgtccgatatcaggacttggacattgcgctt

SEQ ID NO: 5374 - DNA, 32 bp, Artificial Sequence
  Synthetic polynucleotide
gtgttaaccagaattaacacagttaggcgagg

SEQ ID NO: 5375 - DNA, 32 bp, Artificial Sequence
  Synthetic polynucleotide
ttaatttagtgcggcccccacgttgacgcccc

SEQ ID NO: 5376 - DNA, 32 bp, Artificial Sequence
  Synthetic polynucleotide
aagcctgtcgtaaaacgtcgggtcgccgtaaa

SEQ ID NO: 5377 - DNA, 32 bp, Artificial Sequence
  Synthetic polynucleotide
gtgatcctaacgtctagatgatacttaatggg

SEQ ID NO: 5378 - DNA, 32 bp, Artificial Sequence; identical to SEQ ID NO: 4629
  Synthetic polynucleotide

SEQ ID NO: 5379 - DNA, 32 bp, Artificial Sequence; identical to SEQ ID NO: 4630
  Synthetic polynucleotide

SEQ ID NO: 5380 - DNA, 32 bp, Artificial Sequence
  Synthetic polynucleotide
gattatgcatagacggatcccgttcacagcgc

SEQ ID NO: 5381 - DNA, 32 bp, Artificial Sequence
  Synthetic polynucleotide
ataacggatttgtgtaagttggtcgatgtcaa

SEQ ID NO: 5382 - DNA, 32 bp, Artificial Sequence
  Synthetic polynucleotide
aggctagacttagaggggcgattaaacaccca

SEQ ID NO: 5383 - DNA, 32 bp, Artificial Sequence
  Synthetic polynucleotide
acgtttaaaggattatgcttaacttataccat

SEQ ID NO: 5384 - DNA, 32 bp, Artificial Sequence
  Synthetic polynucleotide
gttaggaaagtgatagtgcgaaaagcaagccg

SEQ ID NO: 5385 - DNA, 32 bp, Artificial Sequence
  Synthetic polynucleotide
tcgtgttcccacgtggtagggtcaagcacagg

SEQ ID NO: 5386 - DNA, 32 bp, Artificial Sequence
  Synthetic polynucleotide
gagtcatgtacgcctgtcttatggatggagta

SEQ ID NO: 5387 - DNA, 32 bp, Artificial Sequence
  Synthetic polynucleotide
aacccactcaatggctaacttcttagtagtta

SEQ ID NO: 5388 - DNA, 32 bp, Artificial Sequence
  Synthetic polynucleotide
attggctttacgtccaccgctgaaggcagtgg

SEQ ID NO: 5389 - DNA, 32 bp, Artificial Sequence
  Synthetic polynucleotide
gttactattgcaatttggttgagtaactccgg

SEQ ID NO: 5390 - DNA, 32 bp, Artificial Sequence
  Synthetic polynucleotide
cataagccgcgccgttcatgtgactaaaccgc

SEQ ID NO: 5391 - DNA, 32 bp, Artificial Sequence
  Synthetic polynucleotide
ccgtgacaacttctacagtatggcttctcatt

SEQ ID NO: 5392 - DNA, 32 bp, Artificial Sequence
  Synthetic polynucleotide
tgactcctgcccctgataaaagcgcgaagacc

SEQ ID NO: 5393 - DNA, 32 bp, Artificial Sequence
  Synthetic polynucleotide
ataaccttcgcgcacgaagacagtggacttca

SEQ ID NO: 5394 - DNA, 32 bp, Artificial Sequence
  Synthetic polynucleotide
ttcggacggttctcgaagctgtatcaggtttt

SEQ ID NO: 5395 - DNA, 32 bp, Artificial Sequence
  Synthetic polynucleotide
gaccaatcggcaggttcaatggccagaccatc

SEQ ID NO: 5396 - DNA, 32 bp, Artificial Sequence
  Synthetic polynucleotide
tttctaattcatttggcgcgtctgcgtgatta

SEQ ID NO: 5397 - DNA, 32 bp, Artificial Sequence
  Synthetic polynucleotide
gaagagtgcttgagccgtggcgtatacgacga

SEQ ID NO: 5398 - DNA, 48 bp, Artificial Sequence
  Synthetic polynucleotide
ggggtcacataggacacaacagttcgctcagctacgagctgctgccat

SEQ ID NO: 5399 - DNA, 48 bp, Artificial Sequence
  Synthetic polynucleotide
agttactgagacctgtaacagcatggcttcattagcccggctcccggt

SEQ ID NO: 5400 - DNA, 48 bp, Artificial Sequence
  Synthetic polynucleotide
cgagtcgtgttccggttcagaaaccacccccgacttacgtgtagtgtc

SEQ ID NO: 5401 - DNA, 48 bp, Artificial Sequence
  Synthetic polynucleotide
tgattagctgtcgaaagccggagtagacgtgccacgcgagctatgtag

SEQ ID NO: 5402 - DNA, 48 bp, Artificial Sequence
  Synthetic polynucleotide
ggtacacgtgggtaagctaatataaggtagagcgtcgtctagcacgca

SEQ ID NO: 5403 - DNA, 48 bp, Artificial Sequence
  Synthetic polynucleotide
tttttgtcggtctaaagtccaacatgataatcctcgtgcttcgagaaa

SEQ ID NO: 5404 - DNA, 48 bp, Artificial Sequence
  Synthetic polynucleotide
cctacaatttctggtcgttatttcagtgcgtacgtcttaatgactacc

SEQ ID NO: 5405 - DNA, 48 bp, Artificial Sequence
  Synthetic polynucleotide
catatattccattacgtccaaaccgcaacctagcaattgctatgtgat

SEQ ID NO: 5406 - DNA, 32 bp, Artificial Sequence; identical to SEQ ID NO: 32
  Synthetic polynucleotide

SEQ ID NO: 5407 - DNA, 32 bp, Artificial Sequence; identical to SEQ ID NO: 50
  Synthetic polynucleotide

SEQ ID NO: 5408 - DNA, 32 bp, Artificial Sequence; identical to SEQ ID NO: 4640
  Synthetic polynucleotide

SEQ ID NO: 5409 - DNA, 32 bp, Artificial Sequence; identical to SEQ ID NO: 417
  Synthetic polynucleotide

SEQ ID NO: 5410 - DNA, 32 bp, Artificial Sequence; identical to SEQ ID NO: 1985
  Synthetic polynucleotide

SEQ ID NO: 5411 - DNA, 32 bp, Artificial Sequence; identical to SEQ ID NO: 2027
  Synthetic polynucleotide

SEQ ID NO: 5412 - DNA, 32 bp, Artificial Sequence; identical to SEQ ID NO: 3571
  Synthetic polynucleotide

SEQ ID NO: 5413 - DNA, 32 bp, Artificial Sequence; identical to SEQ ID NO: 2069
  Synthetic polynucleotide

SEQ ID NO: 5414 - DNA, 32 bp, Artificial Sequence; identical to SEQ ID NO: 4644
  Synthetic polynucleotide

SEQ ID NO: 5415 - DNA, 32 bp, Artificial Sequence; identical to SEQ ID NO: 3787
  Synthetic polynucleotide

SEQ ID NO: 5416 - DNA, 32 bp, Artificial Sequence
  Synthetic polynucleotide
gccagacttttacggcggtaggtgtaagacct

SEQ ID NO: 5417 - DNA, 32 bp, Artificial Sequence; identical to SEQ ID NO: 3788
  Synthetic polynucleotide

SEQ ID NO: 5418 - DNA, 32 bp, Artificial Sequence; identical to SEQ ID NO: 3789
  Synthetic polynucleotide

SEQ ID NO: 5419 - DNA, 32 bp, Artificial Sequence; identical to SEQ ID NO: 1304
  Synthetic polynucleotide

SEQ ID NO: 5420 - DNA, 32 bp, Artificial Sequence; identical to SEQ ID NO: 4216
  Synthetic polynucleotide

SEQ ID NO: 5421 - DNA, 32 bp, Artificial Sequence; identical to SEQ ID NO: 3380
  Synthetic polynucleotide

SEQ ID NO: 5422 - DNA, 32 bp, Artificial Sequence; identical to SEQ ID NO: 3572
  Synthetic polynucleotide

SEQ ID NO: 5423 - DNA, 32 bp, Artificial Sequence; identical to SEQ ID NO: 4652
  Synthetic polynucleotide

SEQ ID NO: 5424 - DNA, 32 bp, Artificial Sequence
  Synthetic polynucleotide
aggaaataccactgccttcctaacgcaggtgc

SEQ ID NO: 5425 - DNA, 32 bp, Artificial Sequence; identical to SEQ ID NO: 3791
  Synthetic polynucleotide

SEQ ID NO: 5426 - DNA, 32 bp, Artificial Sequence
  Synthetic polynucleotide
cagtgataggtcttcgagtgggttttggagtg

SEQ ID NO: 5427 - DNA, 32 bp, Artificial Sequence; identical to SEQ ID NO: 4218
  Synthetic polynucleotide

SEQ ID NO: 5428 - DNA, 32 bp, Artificial Sequence
  Synthetic polynucleotide
tacactcttcgtcgtatgtcacggactgggct

SEQ ID NO: 5429 - DNA, 32 bp, Artificial Sequence
  Synthetic polynucleotide
tttgcgtgtaatcacgaggagtcaaagggctg

SEQ ID NO: 5430 - DNA, 32 bp, Artificial Sequence
  Synthetic polynucleotide
agtgcgttgatggtctaaggttattaaacaaa

SEQ ID NO: 5431 - DNA, 32 bp, Artificial Sequence
  Synthetic polynucleotide
aaggactctggttaaggattggtcccccacat

SEQ ID NO: 5432 - DNA, 32 bp, Artificial Sequence
  Synthetic polynucleotide
tacaaagagtccatgtattagaaactaaccga

SEQ ID NO: 5433 - DNA, 32 bp, Artificial Sequence
  Synthetic polynucleotide
atcttgggactatcattctttgcgcttggaac

SEQ ID NO: 5434 - DNA, 32 bp, Artificial Sequence
  Synthetic polynucleotide
tctttttttgtttccccctcacctcctgaggt

SEQ ID NO: 5435 - DNA, 32 bp, Artificial Sequence
  Synthetic polynucleotide
tcaccaacggtagttcggcgccaggattcctc

SEQ ID NO: 5436 - DNA, 48 bp, Artificial Sequence
  Synthetic polynucleotide
gaactggtagatcaccgattctccatggcagcgcttcggtacaggtct

SEQ ID NO: 5437 - DNA, 48 bp, Artificial Sequence
  Synthetic polynucleotide
tgacgcagcatgtatgtatgggcctcatcccctgttaaaacccacagg

SEQ ID NO: 5438 - DNA, 48 bp, Artificial Sequence; identical to SEQ ID NO: 4660
  Synthetic polynucleotide

SEQ ID NO: 5439 - DNA, 48 bp, Artificial Sequence
  Synthetic polynucleotide
aactctagtactccatccataagacgaaccacccgcgggcccacgtgg

SEQ ID NO: 5440 - DNA, 48 bp, Artificial Sequence
  Synthetic polynucleotide
cgagcgcgaaaacctgatacagctattcaattatcaaccacgtgcgcg

SEQ ID NO: 5441 - DNA, 48 bp, Artificial Sequence
  Synthetic polynucleotide
ataaaagctaagagtgcgacaggcacacaattgaatacgacttaacca

SEQ ID NO: 5442 - DNA, 32 bp, Artificial Sequence
  Synthetic polynucleotide
ccgcacgtgaccaagttcacataccagctgga

SEQ ID NO: 5443 - DNA, 32 bp, Artificial Sequence
  Synthetic polynucleotide
ggtaggttcaaatctgtcgtattaggctccaa

SEQ ID NO: 5444 - DNA, 32 bp, Artificial Sequence
  Synthetic polynucleotide
cgtcacttctgcccaggaccacgtcctctcct

SEQ ID NO: 5445 - DNA, 32 bp, Artificial Sequence
  Synthetic polynucleotide
agccgaacgttaatgcaggaggtggggtgacc

SEQ ID NO: 5446 - DNA, 32 bp, Artificial Sequence
  Synthetic polynucleotide
ccatatgaacccatccctgcgtcataggtgct

SEQ ID NO: 5447 - DNA, 32 bp, Artificial Sequence
  Synthetic polynucleotide
gaaaactggaggttagttgtcttagtagttaa

SEQ ID NO: 5448 - DNA, 32 bp, Artificial Sequence
  Synthetic polynucleotide
gagctcacccggcgaaacatgaggtggctggt

SEQ ID NO: 5449 - DNA, 32 bp, Artificial Sequence
  Synthetic polynucleotide
ggttcgtggtcaagactttgcaccacctatac

SEQ ID NO: 5450 - DNA, 32 bp, Artificial Sequence
  Synthetic polynucleotide
taacaaggccggcggaagggccaacgtcgatc

SEQ ID NO: 5451 - DNA, 32 bp, Artificial Sequence
  Synthetic polynucleotide
gactctcttgatcaattgctcgcggggatttc

SEQ ID NO: 5452 - DNA, 32 bp, Artificial Sequence
  Synthetic polynucleotide
taacatcggcgagataagtctggcaacgggtt

SEQ ID NO: 5453 - DNA, 32 bp, Artificial Sequence
  Synthetic polynucleotide
ccgaagttactacacctgcgaggatagataag

SEQ ID NO: 5454 - DNA, 32 bp, Artificial Sequence
  Synthetic polynucleotide
ttacctatagtgaccgaaggtatatgattcaa

SEQ ID NO: 5455 - DNA, 32 bp, Artificial Sequence
  Synthetic polynucleotide
tagcactaaggtcttatttgctacgatatggc

SEQ ID NO: 5456 - DNA, 32 bp, Artificial Sequence
  Synthetic polynucleotide
agggattgcacaaagagtggtccaattcatgg

SEQ ID NO: 5457 - DNA, 32 bp, Artificial Sequence
  Synthetic polynucleotide
tcggtgaccgcgtgtaacttaaccgaggcctt

SEQ ID NO: 5458 - DNA, 32 bp, Artificial Sequence
  Synthetic polynucleotide
cctgcctaactccgctactacaggctccgact

SEQ ID NO: 5459 - DNA, 32 bp, Artificial Sequence
  Synthetic polynucleotide
cgctgtaagcaggtgggcctcttactgccttg

SEQ ID NO: 5460 - DNA, 32 bp, Artificial Sequence; identical to SEQ ID NO: 4682
  Synthetic polynucleotide

SEQ ID NO: 5461 - DNA, 32 bp, Artificial Sequence; identical to SEQ ID NO: 4683
  Synthetic polynucleotide

SEQ ID NO: 5462 - DNA, 32 bp, Artificial Sequence
  Synthetic polynucleotide
tcaccctaggggacaactagagttgtggtgcg

SEQ ID NO: 5463 - DNA, 32 bp, Artificial Sequence
  Synthetic polynucleotide
gccgttctataaaactcgcagaagcctaaaga

SEQ ID NO: 5464 - DNA, 32 bp, Artificial Sequence
  Synthetic polynucleotide
tcccaatctccacgaatatttccttacctgct

SEQ ID NO: 5465 - DNA, 32 bp, Artificial Sequence
  Synthetic polynucleotide
agtgacaactgcgcaggacagaacaaccccct

SEQ ID NO: 5466 - DNA, 32 bp, Artificial Sequence
  Synthetic polynucleotide
agcgcgccttcggcatgcacgacaggcctcgg

SEQ ID NO: 5467 - DNA, 32 bp, Artificial Sequence
  Synthetic polynucleotide
cttttctgtagcgggctggtatcgcgtcgacc

SEQ ID NO: 5468 - DNA, 32 bp, Artificial Sequence
  Synthetic polynucleotide
tacgggtggcacctgctatcactgtaccgaga

SEQ ID NO: 5469 - DNA, 32 bp, Artificial Sequence
  Synthetic polynucleotide
tcagtacgccctccgctcgaccgaccatacag

SEQ ID NO: 5470 - DNA, 32 bp, Artificial Sequence
  Synthetic polynucleotide
tttcaatagggcgtcacgcgctcggcacacca

SEQ ID NO: 5471 - DNA, 32 bp, Artificial Sequence
  Synthetic polynucleotide
ctcgagcacactccaaaacgcactctacgctg

SEQ ID NO: 5472 - DNA, 32 bp, Artificial Sequence
  Synthetic polynucleotide
atctaaagatggcatgcacgcaaataaagtta

SEQ ID NO: 5473 - DNA, 32 bp, Artificial Sequence
  Synthetic polynucleotide
gtcattgtcggatatgagagtgtaggcacgcg

SEQ ID NO: 5474 - DNA, 32 bp, Artificial Sequence
  Synthetic polynucleotide
taagcgcgaagcgacatagggaggtctgcccc

SEQ ID NO: 5475 - DNA, 32 bp, Artificial Sequence
  Synthetic polynucleotide
ccatatagagcccagttctttgtattcgtagg

SEQ ID NO: 5476 - DNA, 32 bp, Artificial Sequence
  Synthetic polynucleotide
gtgaccagcagcccttgagtccttatagtttg

SEQ ID NO: 5477 - DNA, 32 bp, Artificial Sequence
  Synthetic polynucleotide
tcattgggtttgtttatattacgtccggcggc

SEQ ID NO: 5478 - DNA, 48 bp, Artificial Sequence
  Synthetic polynucleotide
agggctgaatcgttctataaaaatcatttcaggatgaacagaacaacg

SEQ ID NO: 5479 - DNA, 48 bp, Artificial Sequence
  Synthetic polynucleotide
tgagatcggttccaagcgcaaagaatccgccgtctccgttacatggac

SEQ ID NO: 5480 - DNA, 48 bp, Artificial Sequence
  Synthetic polynucleotide
atgggttaacctcaggaggtgagggggctgcaatgatcaccttaacca

SEQ ID NO: 5481 - DNA, 48 bp, Artificial Sequence
  Synthetic polynucleotide
ctgcctatgaggaatcctggcgcctggttaagaacttcattaattcat

SEQ ID NO: 5482 - DNA, 48 bp, Artificial Sequence
  Synthetic polynucleotide
atgagacctgatgttcctaggtgtcactttcagttctaaatttttttt

SEQ ID NO: 5483 - DNA, 48 bp, Artificial Sequence
  Synthetic polynucleotide
aggcgttggactatggcaaccagtaaagcgaacactcctatttttttt

SEQ ID NO: 5484 - DNA, 48 bp, Artificial Sequence
  Synthetic polynucleotide
ggacaccggcaccctgtcatcgataaaagcttttcaccaatttttttt

SEQ ID NO: 5485 - DNA, 48 bp, Artificial Sequence
  Synthetic polynucleotide
atgagatcggcgagatggcatagatgcattacagcccgcctttttttt

SEQ ID NO: 5486 - DNA, 32 bp, Artificial Sequence; identical to SEQ ID NO: 4377
  Synthetic polynucleotide

SEQ ID NO: 5487 - DNA, 32 bp, Artificial Sequence
  Synthetic polynucleotide
accacctccgatgtcagcgccgcatacccatt

SEQ ID NO: 5488 - DNA, 32 bp, Artificial Sequence; identical to SEQ ID NO: 4381
  Synthetic polynucleotide

SEQ ID NO: 5489 - DNA, 32 bp, Artificial Sequence
  Synthetic polynucleotide
cctcgtgatatcagaggtcgtaactcggtcgc

SEQ ID NO: 5490 - DNA, 32 bp, Artificial Sequence
  Synthetic polynucleotide
cattccaatatcgagatccacacaagcaaaga

SEQ ID NO: 5491 - DNA, 32 bp, Artificial Sequence; identical to SEQ ID NO: 4717
  Synthetic polynucleotide

SEQ ID NO: 5492 - DNA, 32 bp, Artificial Sequence; identical to SEQ ID NO: 4389
  Synthetic polynucleotide

SEQ ID NO: 5493 - DNA, 32 bp, Artificial Sequence
  Synthetic polynucleotide
ccagtctgacctctattactcgtcagaataga

SEQ ID NO: 5494 - DNA, 32 bp, Artificial Sequence
  Synthetic polynucleotide
aacaacccgcacacagaaccctaatgcggaca

SEQ ID NO: 5495 - DNA, 32 bp, Artificial Sequence; identical to SEQ ID NO: 1668
  Synthetic polynucleotide

SEQ ID NO: 5496 - DNA, 32 bp, Artificial Sequence
  Synthetic polynucleotide
tttagaactgaaagtgaggtcaacgtaccgat

SEQ ID NO: 5497 - DNA, 32 bp, Artificial Sequence
  Synthetic polynucleotide
ggcgggctgtaatgcactttgccacgcagaca

SEQ ID NO: 5498 - DNA, 32 bp, Artificial Sequence
  Synthetic polynucleotide
ttttttttgctgtatttaattagttttttttt

SEQ ID NO: 5499 - DNA, 32 bp, Artificial Sequence
  Synthetic polynucleotide
tttttttttaggtttccataggtatttttttt

SEQ ID NO: 5500 - DNA, 32 bp, Artificial Sequence
  Synthetic polynucleotide
tttttttttcgcgtcgccagccgctttttttt

SEQ ID NO: 5501 - DNA, 32 bp, Artificial Sequence
  Synthetic polynucleotide
ttttttttaatgggtagacatgaatttttttt

SEQ ID NO: 5502 - DNA, 32 bp, Artificial Sequence
  Synthetic polynucleotide
ttttttttctgtgctcgaggtggttttttttt

SEQ ID NO: 5503 - DNA, 32 bp, Artificial Sequence
  Synthetic polynucleotide
tttttttttatctctttaagcgcgtttttttt

SEQ ID NO: 5504 - DNA, 32 bp, Artificial Sequence
  Synthetic polynucleotide
ttttttttggtcattgactctcgttttttttt

SEQ ID NO: 5505 - DNA, 32 bp, Artificial Sequence
  Synthetic polynucleotide
ttttttttgggcacgatcatacgatttttttt

SEQ ID NO: 5506 - DNA, 32 bp, Artificial Sequence
  Synthetic polynucleotide
tttttttttcaatttcgtggcgcttttttttt

SEQ ID NO: 5507 - DNA, 32 bp, Artificial Sequence
  Synthetic polynucleotide
ttttttttaaaacgacttacgccctttttttt

SEQ ID NO: 5508 - DNA, 32 bp, Artificial Sequence
  Synthetic polynucleotide
ttttttttgcgagggtacttaatatttttttt

SEQ ID NO: 5509 - DNA, 32 bp, Artificial Sequence
  Synthetic polynucleotide
ttttttttgcgaccgaaccaatcatttttttt

SEQ ID NO: 5510 - DNA, 32 bp, Artificial Sequence
  Synthetic polynucleotide
tttttttttatctttctcacgaggtttttttt

SEQ ID NO: 5511 - DNA, 32 bp, Artificial Sequence
  Synthetic polynucleotide
tttttttttattaatgatcccctctttttttt

SEQ ID NO: 5512 - DNA, 32 bp, Artificial Sequence
  Synthetic polynucleotide
ttttttttccttgatgcgtgacggtttttttt

SEQ ID NO: 5513 - DNA, 32 bp, Artificial Sequence
  Synthetic polynucleotide
tttttttttcggtcacacacagtgtttttttt

SEQ ID NO: 5514 - DNA, 32 bp, Artificial Sequence
  Synthetic polynucleotide
tttttttttctttgcttagtgacgtttttttt

SEQ ID NO: 5515 - DNA, 32 bp, Artificial Sequence
  Synthetic polynucleotide
ttttttttacaaaccctggacaaatttttttt

SEQ ID NO: 5516 - DNA, 32 bp, Artificial Sequence
  Synthetic polynucleotide
ttttttttcccgctgacgcattactttttttt

SEQ ID NO: 5517 - DNA, 32 bp, Artificial Sequence
  Synthetic polynucleotide
ttttttttctctatatgacccacgtttttttt

SEQ ID NO: 5518 - DNA, 32 bp, Artificial Sequence; identical to SEQ ID NO: 4741
  Synthetic polynucleotide

SEQ ID NO: 5519 - DNA, 32 bp, Artificial Sequence; identical to SEQ ID NO: 4742
  Synthetic polynucleotide

SEQ ID NO: 5520 - DNA, 32 bp, Artificial Sequence; identical to SEQ ID NO: 4743
  Synthetic polynucleotide

SEQ ID NO: 5521 - DNA, 32 bp, Artificial Sequence
  Synthetic polynucleotide
tttttttttagagcacttggaatgtttttttt

SEQ ID NO: 5522 - DNA, 32 bp, Artificial Sequence
  Synthetic polynucleotide
ttttttttcagtaagtatgaaccctttttttt

SEQ ID NO: 5523 - DNA, 32 bp, Artificial Sequence
  Synthetic polynucleotide
tttttttttgtccgtccaaggacatttttttt

SEQ ID NO: 5524 - DNA, 32 bp, Artificial Sequence
  Synthetic polynucleotide
ttttttttcgtccaccgcacgtattttttttt

SEQ ID NO: 5525 - DNA, 32 bp, Artificial Sequence
  Synthetic polynucleotide
tttttttttctattctcaagtgcctttttttt

SEQ ID NO: 5526 - DNA, 32 bp, Artificial Sequence
  Synthetic polynucleotide
ttttttttccaatagacagactggtttttttt

SEQ ID NO: 5527 - DNA, 32 bp, Artificial Sequence
  Synthetic polynucleotide
ttttttttcctctgtaatttccgttttttttt

SEQ ID NO: 5528 - DNA, 32 bp, Artificial Sequence
  Synthetic polynucleotide
tttttttttggcaagcaatcgtgatttttttt

SEQ ID NO: 5529 - DNA, 32 bp, Artificial Sequence
  Synthetic polynucleotide
tttttttttggttaactgcaattatttttttt

SEQ ID NO: 5530 - DNA, 32 bp, Artificial Sequence
  Synthetic polynucleotide
tttttttttgtccgcaatccgccttttttttt

SEQ ID NO: 5531 - DNA, 32 bp, Artificial Sequence
  Synthetic polynucleotide
ttttttttcttggtttggatctgatttttttt

SEQ ID NO: 5532 - DNA, 32 bp, Artificial Sequence
  Synthetic polynucleotide
ttttttttaaagtatgttccgatttttttttt

SEQ ID NO: 5533 - DNA, 32 bp, Artificial Sequence
  Synthetic polynucleotide
ttttttttaaccgtcccggcctactttttttt

SEQ ID NO: 5534 - DNA, 32 bp, Artificial Sequence
  Synthetic polynucleotide
ttttttttaaatacccgtagaatgtttttttt

SEQ ID NO: 5535 - DNA, 32 bp, Artificial Sequence
  Synthetic polynucleotide
ttttttttgatgccccgtactaattttttttt

SEQ ID NO: 5536 - DNA, 32 bp, Artificial Sequence
  Synthetic polynucleotide
tttttttttcatctgaggacgtcttttttttt

SEQ ID NO: 5537 - DNA, 32 bp, Artificial Sequence
  Synthetic polynucleotide
ttttttttctgacagagggttgtttttttttt

SEQ ID NO: 5538 - DNA, 32 bp, Artificial Sequence
  Synthetic polynucleotide
ttttttttatcggtacatcggcactttttttt

SEQ ID NO: 5539 - DNA, 32 bp, Artificial Sequence
  Synthetic polynucleotide
tttttttttcacgacctcctgtaatttttttt

SEQ ID NO: 5540 - DNA, 32 bp, Artificial Sequence
  Synthetic polynucleotide
ttttttttagccttcggaacgggctttttttt

SEQ ID NO: 5541 - DNA, 32 bp, Artificial Sequence
  Synthetic polynucleotide
tttttttttgtctgcgacaatctctttttttt

SEQ ID NO: 5542 - DNA, 48 bp, Artificial Sequence
  Synthetic polynucleotide
ttttttttgagccacttaacctggtactcgattgtcgtattgacatcg

SEQ ID NO: 5543 - DNA, 48 bp, Artificial Sequence
  Synthetic polynucleotide
ttttttttaagtgtgtcaccgttcttatgctatacttgaattacttgg

SEQ ID NO: 5544 - DNA, 48 bp, Artificial Sequence
  Synthetic polynucleotide
tttttttttcagtcgtcgcacggcgcgtatcctggatatcatgccagc

SEQ ID NO: 5545 - DNA, 48 bp, Artificial Sequence
  Synthetic polynucleotide
ttttttttatcatggtgtcgcataactgttagagctctgttcctatga

SEQ ID NO: 5546 - DNA, 48 bp, Artificial Sequence
  Synthetic polynucleotide
ggataagggattcggtctaggctagatgatctagctgcgttttttttt

SEQ ID NO: 5547 - DNA, 48 bp, Artificial Sequence
  Synthetic polynucleotide
tgcggacagaggcgccaaagggccagctagacgtataaactttttttt

SEQ ID NO: 5548 - DNA, 48 bp, Artificial Sequence
  Synthetic polynucleotide
tagtgaacattgagcccacaacccgggcgcttttgcgctgtttttttt

SEQ ID NO: 5549 - DNA, 48 bp, Artificial Sequence
  Synthetic polynucleotide
tatttgccgactgcttggcacaatctgacgaccatgatcctttttttt

SEQ ID NO: 5550 - DNA, 32 bp, Artificial Sequence; identical to SEQ ID NO: 162
  Synthetic polynucleotide

SEQ ID NO: 5551 - DNA, 32 bp, Artificial Sequence; identical to SEQ ID NO: 4145
  Synthetic polynucleotide

SEQ ID NO: 5552 - DNA, 32 bp, Artificial Sequence; identical to SEQ ID NO: 4485
  Synthetic polynucleotide

SEQ ID NO: 5553 - DNA, 32 bp, Artificial Sequence; identical to SEQ ID NO: 4147
  Synthetic polynucleotide

SEQ ID NO: 5554 - DNA, 32 bp, Artificial Sequence
  Synthetic polynucleotide
cgcgttagatgttaacttatgcattgcggtac

SEQ ID NO: 5555 - DNA, 32 bp, Artificial Sequence; identical to SEQ ID NO: 4760
  Synthetic polynucleotide

SEQ ID NO: 5556 - DNA, 32 bp, Artificial Sequence; identical to SEQ ID NO: 4493
  Synthetic polynucleotide

SEQ ID NO: 5557 - DNA, 32 bp, Artificial Sequence; identical to SEQ ID NO: 4151
  Synthetic polynucleotide

SEQ ID NO: 5558 - DNA, 32 bp, Artificial Sequence
  Synthetic polynucleotide
agcggctcaccgacaacttcattccacggaga

SEQ ID NO: 5559 - DNA, 32 bp, Artificial Sequence
  Synthetic polynucleotide
agcgccaaaggtgcgtttggttcagatataga

SEQ ID NO: 5560 - DNA, 32 bp, Artificial Sequence
  Synthetic polynucleotide
acgcagctagatcatcaatgtgctcgagccag

SEQ ID NO: 5561 - DNA, 32 bp, Artificial Sequence
  Synthetic polynucleotide
ggatcatggtcgtcagttgaagtataccgaac

SEQ ID NO: 5562 - DNA, 32 bp, Artificial Sequence
  Synthetic polynucleotide
tttttttttaagccacatgtagcatttttttt

SEQ ID NO: 5563 - DNA, 32 bp, Artificial Sequence
  Synthetic polynucleotide
ttttttttaggacgatagattgtatttttttt

SEQ ID NO: 5564 - DNA, 32 bp, Artificial Sequence
  Synthetic polynucleotide
ttttttttgtcctcacgcgggccgtttttttt

SEQ ID NO: 5565 - DNA, 32 bp, Artificial Sequence
  Synthetic polynucleotide
tttttttttggtgaatgcaccgaatttttttt

SEQ ID NO: 5566 - DNA, 32 bp, Artificial Sequence
  Synthetic polynucleotide
ttttttttgccgggcttcctcggttttttttt

SEQ ID NO: 5567 - DNA, 32 bp, Artificial Sequence
  Synthetic polynucleotide
ttttttttcgtaccttgcctggcctttttttt

SEQ ID NO: 5568 - DNA, 32 bp, Artificial Sequence
  Synthetic polynucleotide
ttttttttcacaggatcgaatcgctttttttt

SEQ ID NO: 5569 - DNA, 32 bp, Artificial Sequence
  Synthetic polynucleotide
ttttttttcgaaggtcggaatgcatttttttt

SEQ ID NO: 5570 - DNA, 32 bp, Artificial Sequence
  Synthetic polynucleotide
ttttttttggagtgttgacccaggtttttttt

SEQ ID NO: 5571 - DNA, 32 bp, Artificial Sequence
  Synthetic polynucleotide
ttttttttcccgttcctaacagcatttttttt

SEQ ID NO: 5572 - DNA, 32 bp, Artificial Sequence
  Synthetic polynucleotide
tttttttttttgcattggtagaagtttttttt

SEQ ID NO: 5573 - DNA, 32 bp, Artificial Sequence
  Synthetic polynucleotide
tttttttttagcgtctttctgctatttttttt

SEQ ID NO: 5574 - DNA, 32 bp, Artificial Sequence
  Synthetic polynucleotide
ttttttttctaccgacagacgttttttttttt

SEQ ID NO: 5575 - DNA, 32 bp, Artificial Sequence; identical to SEQ ID NO: 3697
  Synthetic polynucleotide

SEQ ID NO: 5576 - DNA, 32 bp, Artificial Sequence
  Synthetic polynucleotide
ttttttttgggacatggaagaggttttttttt

SEQ ID NO: 5577 - DNA, 32 bp, Artificial Sequence
  Synthetic polynucleotide
ttttttttttatttacgctcattctttttttt

SEQ ID NO: 5578 - DNA, 32 bp, Artificial Sequence
  Synthetic polynucleotide
ttttttttgtaccgcaacgttgtttttttttt

SEQ ID NO: 5579 - DNA, 32 bp, Artificial Sequence
  Synthetic polynucleotide
ttttttttgtcactgctacaggtgtttttttt

SEQ ID NO: 5580 - DNA, 32 bp, Artificial Sequence
  Synthetic polynucleotide
ttttttttacgggtacaatgagcttttttttt

SEQ ID NO: 5581 - DNA, 32 bp, Artificial Sequence
  Synthetic polynucleotide
ttttttttagctaccgaccctggctttttttt

SEQ ID NO: 5582 - DNA, 32 bp, Artificial Sequence; identical to SEQ ID NO: 4784
  Synthetic polynucleotide

SEQ ID NO: 5583 - DNA, 32 bp, Artificial Sequence; identical to SEQ ID NO: 4785
  Synthetic polynucleotide

SEQ ID NO: 5584 - DNA, 32 bp, Artificial Sequence; identical to SEQ ID NO: 4283
  Synthetic polynucleotide

SEQ ID NO: 5585 - DNA, 32 bp, Artificial Sequence
  Synthetic polynucleotide
ttttttttaagtccgtctaacgcgtttttttt

SEQ ID NO: 5586 - DNA, 32 bp, Artificial Sequence
  Synthetic polynucleotide
ttttttttcggtgcatgcatgctgtttttttt

SEQ ID NO: 5587 - DNA, 32 bp, Artificial Sequence
  Synthetic polynucleotide
tttttttttcccccaataggtatgtttttttt

SEQ ID NO: 5588 - DNA, 32 bp, Artificial Sequence
  Synthetic polynucleotide
tttttttttattgctgactacttatttttttt

SEQ ID NO: 5589 - DNA, 32 bp, Artificial Sequence
  Synthetic polynucleotide
tttttttttttcctttaggtagtctttttttt

SEQ ID NO: 5590 - DNA, 32 bp, Artificial Sequence
  Synthetic polynucleotide
ttttttttacctctcaccagcatctttttttt

SEQ ID NO: 5591 - DNA, 32 bp, Artificial Sequence
  Synthetic polynucleotide
ttttttttgtactctgtgtatggttttttttt

SEQ ID NO: 5592 - DNA, 32 bp, Artificial Sequence
  Synthetic polynucleotide
ttttttttgcacggaagtggcggatttttttt

SEQ ID NO: 5593 - DNA, 32 bp, Artificial Sequence
  Synthetic polynucleotide
tttttttttgctcaagagtgcgactttttttt

SEQ ID NO: 5594 - DNA, 32 bp, Artificial Sequence
  Synthetic polynucleotide
tttttttttctccgtgtcactttgtttttttt

SEQ ID NO: 5595 - DNA, 32 bp, Artificial Sequence
  Synthetic polynucleotide
tttttttttgttgttggagccgaatttttttt

SEQ ID NO: 5596 - DNA, 32 bp, Artificial Sequence
  Synthetic polynucleotide
tttttttttctcgtctcctggttgtttttttt

SEQ ID NO: 5597 - DNA, 32 bp, Artificial Sequence
  Synthetic polynucleotide
tttttttttctatatccccggtggtttttttt

SEQ ID NO: 5598 - DNA, 32 bp, Artificial Sequence
  Synthetic polynucleotide
ttttttttggagttatttggcgcttttttttt

SEQ ID NO: 5599 - DNA, 32 bp, Artificial Sequence
  Synthetic polynucleotide
ttttttttggtcgttccacgcggttttttttt

SEQ ID NO: 5600 - DNA, 32 bp, Artificial Sequence
  Synthetic polynucleotide
tttttttttcctatgacgcgctcatttttttt

SEQ ID NO: 5601 - DNA, 32 bp, Artificial Sequence
  Synthetic polynucleotide
ttttttttctgaaacagagccgcttttttttt

SEQ ID NO: 5602 - DNA, 32 bp, Artificial Sequence
  Synthetic polynucleotide
ttttttttctggctcgctatgtgatttttttt

SEQ ID NO: 5603 - DNA, 32 bp, Artificial Sequence
  Synthetic polynucleotide
ttttttttcctgcatagcctcccgtttttttt

SEQ ID NO: 5604 - DNA, 32 bp, Artificial Sequence
  Synthetic polynucleotide
tttttttttgcagaatatgttccatttttttt

SEQ ID NO: 5605 - DNA, 32 bp, Artificial Sequence
  Synthetic polynucleotide
ttttttttgttcggtaccgccttgtttttttt

SEQ ID NO: 5606 - DNA, 48 bp, Artificial Sequence
  Synthetic polynucleotide
ttttttttaaccgtgagtatgattgcggccattcacagtgcctgcgaa

SEQ ID NO: 5607 - DNA, 48 bp, Artificial Sequence
  Synthetic polynucleotide
tttttttttaagcgttacaggcggaggatatgcactcgcacttagatc

SEQ ID NO: 5608 - DNA, 48 bp, Artificial Sequence
  Synthetic polynucleotide
ttttttttgaagcgtaatcgactatatcccaaccccaagtgctacatg

SEQ ID NO: 5609 - DNA, 48 bp, Artificial Sequence
  Synthetic polynucleotide
ttttttttcgcagggtgctatgctacggccacggcggtaccaaacatt

SEQ ID NO: 5610 - DNA, 48 bp, Artificial Sequence
  Synthetic polynucleotide
ccgggctaatgaagccgtgaccccagagactggtttactttttttttt

SEQ ID NO: 5611 - DNA, 48 bp, Artificial Sequence
  Synthetic polynucleotide
cacctcctgttagggtgacacccgggatgggttcatatggtttttttt

SEQ ID NO: 5612 - DNA, 48 bp, Artificial Sequence
  Synthetic polynucleotide
tcctcgcacccattaaaagccaagcggtcactataggtaatttttttt

SEQ ID NO: 5613 - DNA, 48 bp, Artificial Sequence
  Synthetic polynucleotide
ctttgaaacctgtgctgctgcctgttgtcccctagggtgatttttttt

SEQ ID NO: 5614 - DNA, 48 bp, Artificial Sequence
  Synthetic polynucleotide
tcggtcgatgaagtcccatgactctgacgccctattgaaatttttttt

SEQ ID NO: 5615 - DNA, 48 bp, Artificial Sequence
  Synthetic polynucleotide
acgtaataatgaattacgtccgaaattcggataccggtagtttttttt

SEQ ID NO: 5616 - DNA, 32 bp, Artificial Sequence
  Synthetic polynucleotide
aagtaaaccagtctctaccagttctgctgggt

SEQ ID NO: 5617 - DNA, 32 bp, Artificial Sequence
  Synthetic polynucleotide
gtggctggtcgttcgagcagtccgatgttggg

SEQ ID NO: 5618 - DNA, 32 bp, Artificial Sequence
  Synthetic polynucleotide
ccaagtcatatttcgatcaagctgtctgcaac

SEQ ID NO: 5619 - DNA, 32 bp, Artificial Sequence
  Synthetic polynucleotide
cggaacagaaattgtgactttctggctgttca

SEQ ID NO: 5620 - DNA, 32 bp, Artificial Sequence
  Synthetic polynucleotide
ctaccggtatccgaatgcttttatgatgtccg

SEQ ID NO: 5621 - DNA, 32 bp, Artificial Sequence
  Synthetic polynucleotide
agaccgctatgtgggggttggtgatcagcatc

SEQ ID NO: 5622 - DNA, 32 bp, Artificial Sequence
  Synthetic polynucleotide
tacgcgtgtcggttagaaaaaagagtctcacg

SEQ ID NO: 5623 - DNA, 32 bp, Artificial Sequence
  Synthetic polynucleotide
ctagcgtcgatgagcgcccaagattgtatgcc

SEQ ID NO: 5624 - DNA, 32 bp, Artificial Sequence
  Synthetic polynucleotide
ttttttttaccgggagccagccactttttttt

SEQ ID NO: 5625 - DNA, 32 bp, Artificial Sequence
  Synthetic polynucleotide
ttttttttctacatagtgacttggtttttttt

SEQ ID NO: 5626 - DNA, 32 bp, Artificial Sequence
  Synthetic polynucleotide
tttttttttttctcgactgttccgtttttttt

SEQ ID NO: 5627 - DNA, 32 bp, Artificial Sequence
  Synthetic polynucleotide
tttttttttgaacagcacgtgcggtttttttt

SEQ ID NO: 5628 - DNA, 32 bp, Artificial Sequence
  Synthetic polynucleotide
ttttttttgttgcagaaacctacctttttttt

SEQ ID NO: 5629 - DNA, 32 bp, Artificial Sequence
  Synthetic polynucleotide
ttttttttcccaacataagtgacgtttttttt

SEQ ID NO: 5630 - DNA, 32 bp, Artificial Sequence
  Synthetic polynucleotide
ttttttttacccagcagttcggcttttttttt

SEQ ID NO: 5631 - DNA, 32 bp, Artificial Sequence
  Synthetic polynucleotide
ttttttttggtcaccccagttttctttttttt

SEQ ID NO: 5632 - DNA, 32 bp, Artificial Sequence
  Synthetic polynucleotide
ttttttttaggagagggtgagctctttttttt

SEQ ID NO: 5633 - DNA, 32 bp, Artificial Sequence
  Synthetic polynucleotide
ttttttttttggagcccacgaacctttttttt

SEQ ID NO: 5634 - DNA, 32 bp, Artificial Sequence
  Synthetic polynucleotide
ttttttttgtataggtccttgttatttttttt

SEQ ID NO: 5635 - DNA, 32 bp, Artificial Sequence
  Synthetic polynucleotide
ttttttttaccagccaagagagtctttttttt

SEQ ID NO: 5636 - DNA, 32 bp, Artificial Sequence
  Synthetic polynucleotide
ttttttttttaactaccgatgttatttttttt

SEQ ID NO: 5637 - DNA, 32 bp, Artificial Sequence
  Synthetic polynucleotide
ttttttttagcacctaaacttcggtttttttt

SEQ ID NO: 5638 - DNA, 32 bp, Artificial Sequence
  Synthetic polynucleotide
ttttttttcttatctatagtgctatttttttt

SEQ ID NO: 5639 - DNA, 32 bp, Artificial Sequence
  Synthetic polynucleotide
ttttttttaacccgttcaatcccttttttttt

SEQ ID NO: 5640 - DNA, 32 bp, Artificial Sequence
  Synthetic polynucleotide
ttttttttgaaatcccgtcaccgatttttttt

SEQ ID NO: 5641 - DNA, 32 bp, Artificial Sequence
  Synthetic polynucleotide
ttttttttaaggcctctaggcaggtttttttt

SEQ ID NO: 5642 - DNA, 32 bp, Artificial Sequence
  Synthetic polynucleotide
ttttttttccatgaatttacagcgtttttttt

SEQ ID NO: 5643 - DNA, 32 bp, Artificial Sequence
  Synthetic polynucleotide
ttttttttgccatatcaatgtctatttttttt

SEQ ID NO: 5644 - DNA, 32 bp, Artificial Sequence
  Synthetic polynucleotide
ttttttttttgaatcatggtgttatttttttt

SEQ ID NO: 5645 - DNA, 32 bp, Artificial Sequence
  Synthetic polynucleotide
ttttttttgggtcccaagaacggctttttttt

SEQ ID NO: 5646 - DNA, 32 bp, Artificial Sequence
  Synthetic polynucleotide
tttttttttgccatctgattgggatttttttt

SEQ ID NO: 5647 - DNA, 32 bp, Artificial Sequence
  Synthetic polynucleotide
ttttttttcaaggcagttgtcacttttttttt

SEQ ID NO: 5648 - DNA, 32 bp, Artificial Sequence
  Synthetic polynucleotide
ttttttttagggggttggcgcgcttttttttt

SEQ ID NO: 5649 - DNA, 32 bp, Artificial Sequence
  Synthetic polynucleotide
ttttttttagcaggtacagaaaagtttttttt

SEQ ID NO: 5650 - DNA, 32 bp, Artificial Sequence
  Synthetic polynucleotide
tttttttttctttaggcacccgtatttttttt

SEQ ID NO: 5651 - DNA, 32 bp, Artificial Sequence
  Synthetic polynucleotide
ttttttttcgcaccaccgtactgatttttttt

SEQ ID NO: 5652 - DNA, 32 bp, Artificial Sequence
  Synthetic polynucleotide
ttttttttctgtatggtgctcgagtttttttt

SEQ ID NO: 5653 - DNA, 32 bp, Artificial Sequence
  Synthetic polynucleotide
tttttttttctcggtactttagattttttttt

SEQ ID NO: 5654 - DNA, 32 bp, Artificial Sequence
  Synthetic polynucleotide
ttttttttggtcgacgacaatgactttttttt

SEQ ID NO: 5655 - DNA, 32 bp, Artificial Sequence
  Synthetic polynucleotide
ttttttttcgcgtgcccgcgcttatttttttt

SEQ ID NO: 5656 - DNA, 32 bp, Artificial Sequence
  Synthetic polynucleotide
tttttttttaactttactatatggtttttttt

SEQ ID NO: 5657 - DNA, 32 bp, Artificial Sequence
  Synthetic polynucleotide
ttttttttcagcgtagctggtcactttttttt

SEQ ID NO: 5658 - DNA, 32 bp, Artificial Sequence
  Synthetic polynucleotide
tttttttttggtgtgccccaatgatttttttt

SEQ ID NO: 5659 - DNA, 32 bp, Artificial Sequence
  Synthetic polynucleotide
ttttttttgccgccggagcggtcttttttttt

SEQ ID NO: 5660 - DNA, 32 bp, Artificial Sequence
  Synthetic polynucleotide
ttttttttcaaactatcacgcgtatttttttt

SEQ ID NO: 5661 - DNA, 32 bp, Artificial Sequence
  Synthetic polynucleotide
ttttttttcctacgaagacgctagtttttttt

SEQ ID NO: 5662 - DNA, 32 bp, Artificial Sequence
  Synthetic polynucleotide
ttttttttggcatacatcagcccttttttttt

SEQ ID NO: 5663 - DNA, 32 bp, Artificial Sequence
  Synthetic polynucleotide
ttttttttcgtgagaccgatctcatttttttt

SEQ ID NO: 5664 - DNA, 32 bp, Artificial Sequence
  Synthetic polynucleotide
ttttttttgatgctgataacccattttttttt

SEQ ID NO: 5665 - DNA, 32 bp, Artificial Sequence
  Synthetic polynucleotide
ttttttttcggacatcataggcagtttttttt

SEQ ID NO: 5666 - DNA, 48 bp, Artificial Sequence
  Synthetic polynucleotide
ttttttttatcacatagcaattgctaggttgcattgtaggcacaattt

SEQ ID NO: 5667 - DNA, 48 bp, Artificial Sequence
  Synthetic polynucleotide
tttttttttccagctggtatgtgaaagagtcaagcgtaaagtcttgac

SEQ ID NO: 5668 - DNA, 48 bp, Artificial Sequence
  Synthetic polynucleotide
ttttttttgatcgacgttggccctcctcgccttcggacgttacacgcg

SEQ ID NO: 5669 - DNA, 48 bp, Artificial Sequence
  Synthetic polynucleotide
ttttttttagtcggagcctgtagttgggtgtttccgttatctgcgcag

SEQ ID NO: 5670 - DNA, 48 bp, Artificial Sequence
  Synthetic polynucleotide
ttttttttccgaggcctgtcgtgcgcggtttaatagtaaccatatccg

SEQ ID NO: 5671 - DNA, 48 bp, Artificial Sequence
  Synthetic polynucleotide
ttttttttggggcagacctccctacgttgttccactcttccgctcatc

SEQ ID NO: 5672 - DNA, 48 bp, Artificial Sequence; identical to SEQ ID NO: 885
  Synthetic polynucleotide

SEQ ID NO: 5673 - DNA, 32 bp, Artificial Sequence; identical to SEQ ID NO: 3
  Synthetic polynucleotide

SEQ ID NO: 5674 - DNA, 48 bp, Artificial Sequence; identical to SEQ ID NO: 887
  Synthetic polynucleotide

SEQ ID NO: 5675 - DNA, 32 bp, Artificial Sequence; identical to SEQ ID NO: 888
  Synthetic polynucleotide

SEQ ID NO: 5676 - DNA, 48 bp, Artificial Sequence; identical to SEQ ID NO: 889
  Synthetic polynucleotide

SEQ ID NO: 5677 - DNA, 32 bp, Artificial Sequence; identical to SEQ ID NO: 8
  Synthetic polynucleotide

SEQ ID NO: 5678 - DNA, 48 bp, Artificial Sequence; identical to SEQ ID NO: 891
  Synthetic polynucleotide

SEQ ID NO: 5679 - DNA, 32 bp, Artificial Sequence; identical to SEQ ID NO: 892
  Synthetic polynucleotide

SEQ ID NO: 5680 - DNA, 48 bp, Artificial Sequence; identical to SEQ ID NO: 893
  Synthetic polynucleotide

SEQ ID NO: 5681 - DNA, 48 bp, Artificial Sequence; identical to SEQ ID NO: 97
  Synthetic polynucleotide

SEQ ID NO: 5682 - DNA, 48 bp, Artificial Sequence; identical to SEQ ID NO: 895
  Synthetic polynucleotide

SEQ ID NO: 5683 - DNA, 48 bp, Artificial Sequence; identical to SEQ ID NO: 105
  Synthetic polynucleotide

SEQ ID NO: 5684 - DNA, 16 bp, Artificial Sequence
  Synthetic polynucleotide
ttttttttcggagcta

SEQ ID NO: 5685 - DNA, 32 bp, Artificial Sequence; identical to SEQ ID NO: 898
  Synthetic polynucleotide

SEQ ID NO: 5686 - DNA, 48 bp, Artificial Sequence; identical to SEQ ID NO: 899
  Synthetic polynucleotide

SEQ ID NO: 5687 - DNA, 32 bp, Artificial Sequence; identical to SEQ ID NO: 900
  Synthetic polynucleotide

SEQ ID NO: 5688 - DNA, 48 bp, Artificial Sequence; identical to SEQ ID NO: 901
  Synthetic polynucleotide

SEQ ID NO: 5689 - DNA, 32 bp, Artificial Sequence; identical to SEQ ID NO: 902
  Synthetic polynucleotide

SEQ ID NO: 5690 - DNA, 48 bp, Artificial Sequence; identical to SEQ ID NO: 903
  Synthetic polynucleotide

SEQ ID NO: 5691 - DNA, 32 bp, Artificial Sequence; identical to SEQ ID NO: 904
  Synthetic polynucleotide

SEQ ID NO: 5692 - DNA, 32 bp, Artificial Sequence; identical to SEQ ID NO: 905
  Synthetic polynucleotide

SEQ ID NO: 5693 - DNA, 16 bp, Artificial Sequence
  Synthetic polynucleotide
gtccttcctttttttt

SEQ ID NO: 5694 - DNA, 48 bp, Artificial Sequence; identical to SEQ ID NO: 907
  Synthetic polynucleotide

SEQ ID NO: 5695 - DNA, 48 bp, Artificial Sequence; identical to SEQ ID NO: 908
  Synthetic polynucleotide

SEQ ID NO: 5696 - DNA, 48 bp, Artificial Sequence; identical to SEQ ID NO: 909
  Synthetic polynucleotide

SEQ ID NO: 5697 - DNA, 32 bp, Artificial Sequence; identical to SEQ ID NO: 35
  Synthetic polynucleotide

SEQ ID NO: 5698 - DNA, 48 bp, Artificial Sequence; identical to SEQ ID NO: 911
  Synthetic polynucleotide

SEQ ID NO: 5699 - DNA, 32 bp, Artificial Sequence; identical to SEQ ID NO: 37
  Synthetic polynucleotide

SEQ ID NO: 5700 - DNA, 48 bp, Artificial Sequence; identical to SEQ ID NO: 913
  Synthetic polynucleotide

SEQ ID NO: 5701 - DNA, 32 bp, Artificial Sequence; identical to SEQ ID NO: 914
  Synthetic polynucleotide

SEQ ID NO: 5702 - DNA, 48 bp, Artificial Sequence; identical to SEQ ID NO: 149
  Synthetic polynucleotide

SEQ ID NO: 5703 - DNA, 32 bp, Artificial Sequence; identical to SEQ ID NO: 370
  Synthetic polynucleotide

SEQ ID NO: 5704 - DNA, 48 bp, Artificial Sequence; identical to SEQ ID NO: 371
  Synthetic polynucleotide

SEQ ID NO: 5705 - DNA, 32 bp, Artificial Sequence; identical to SEQ ID NO: 918
  Synthetic polynucleotide

SEQ ID NO: 5706 - DNA, 48 bp, Artificial Sequence; identical to SEQ ID NO: 919
  Synthetic polynucleotide

SEQ ID NO: 5707 - DNA, 48 bp, Artificial Sequence; identical to SEQ ID NO: 920
  Synthetic polynucleotide

SEQ ID NO: 5708 - DNA, 48 bp, Artificial Sequence; identical to SEQ ID NO: 921
  Synthetic polynucleotide

SEQ ID NO: 5709 - DNA, 48 bp, Artificial Sequence; identical to SEQ ID NO: 922
  Synthetic polynucleotide

SEQ ID NO: 5710 - DNA, 16 bp, Artificial Sequence
  Synthetic polynucleotide
tttttttttaactgat

SEQ ID NO: 5711 - DNA, 32 bp, Artificial Sequence; identical to SEQ ID NO: 924
  Synthetic polynucleotide

SEQ ID NO: 5712 - DNA, 48 bp, Artificial Sequence; identical to SEQ ID NO: 925
  Synthetic polynucleotide

SEQ ID NO: 5713 - DNA, 32 bp, Artificial Sequence; identical to SEQ ID NO: 926
  Synthetic polynucleotide

SEQ ID NO: 5714 - DNA, 48 bp, Artificial Sequence; identical to SEQ ID NO: 927
  Synthetic polynucleotide

SEQ ID NO: 5715 - DNA, 32 bp, Artificial Sequence; identical to SEQ ID NO: 928
  Synthetic polynucleotide

SEQ ID NO: 5716 - DNA, 48 bp, Artificial Sequence; identical to SEQ ID NO: 929
  Synthetic polynucleotide

SEQ ID NO: 5717 - DNA, 32 bp, Artificial Sequence; identical to SEQ ID NO: 930
  Synthetic polynucleotide

SEQ ID NO: 5718 - DNA, 32 bp, Artificial Sequence; identical to SEQ ID NO: 931
  Synthetic polynucleotide

SEQ ID NO: 5719 - DNA, 16 bp, Artificial Sequence
  Synthetic polynucleotide
gtggccgttttttttt

SEQ ID NO: 5720 - DNA, 48 bp, Artificial Sequence; identical to SEQ ID NO: 933
  Synthetic polynucleotide

SEQ ID NO: 5721 - DNA, 48 bp, Artificial Sequence; identical to SEQ ID NO: 934
  Synthetic polynucleotide

SEQ ID NO: 5722 - DNA, 48 bp, Artificial Sequence; identical to SEQ ID NO: 935
  Synthetic polynucleotide

SEQ ID NO: 5723 - DNA, 32 bp, Artificial Sequence; identical to SEQ ID NO: 936
  Synthetic polynucleotide

SEQ ID NO: 5724 - DNA, 48 bp, Artificial Sequence; identical to SEQ ID NO: 937
  Synthetic polynucleotide

SEQ ID NO: 5725 - DNA, 32 bp, Artificial Sequence; identical to SEQ ID NO: 73
  Synthetic polynucleotide

SEQ ID NO: 5726 - DNA, 48 bp, Artificial Sequence; identical to SEQ ID NO: 939
  Synthetic polynucleotide

SEQ ID NO: 5727 - DNA, 32 bp, Artificial Sequence; identical to SEQ ID NO: 940
  Synthetic polynucleotide

SEQ ID NO: 5728 - DNA, 48 bp, Artificial Sequence; identical to SEQ ID NO: 941
  Synthetic polynucleotide

SEQ ID NO: 5729 - DNA, 32 bp, Artificial Sequence; identical to SEQ ID NO: 78
  Synthetic polynucleotide

SEQ ID NO: 5730 - DNA, 48 bp, Artificial Sequence; identical to SEQ ID NO: 943
  Synthetic polynucleotide

SEQ ID NO: 5731 - DNA, 32 bp, Artificial Sequence; identical to SEQ ID NO: 944
  Synthetic polynucleotide

SEQ ID NO: 5732 - DNA, 48 bp, Artificial Sequence; identical to SEQ ID NO: 945
  Synthetic polynucleotide

SEQ ID NO: 5733 - DNA, 48 bp, Artificial Sequence; identical to SEQ ID NO: 946
  Synthetic polynucleotide

SEQ ID NO: 5734 - DNA, 48 bp, Artificial Sequence; identical to SEQ ID NO: 403
  Synthetic polynucleotide

SEQ ID NO: 5735 - DNA, 48 bp, Artificial Sequence; identical to SEQ ID NO: 948
  Synthetic polynucleotide

SEQ ID NO: 5736 - DNA, 16 bp, Artificial Sequence
  Synthetic polynucleotide
tttttttttaccgggg

SEQ ID NO: 5737 - DNA, 32 bp, Artificial Sequence; identical to SEQ ID NO: 950
  Synthetic polynucleotide

SEQ ID NO: 5738 - DNA, 48 bp, Artificial Sequence; identical to SEQ ID NO: 951
  Synthetic polynucleotide

SEQ ID NO: 5739 - DNA, 32 bp, Artificial Sequence; identical to SEQ ID NO: 952
  Synthetic polynucleotide

SEQ ID NO: 5740 - DNA, 48 bp, Artificial Sequence; identical to SEQ ID NO: 953
  Synthetic polynucleotide

SEQ ID NO: 5741 - DNA, 32 bp, Artificial Sequence; identical to SEQ ID NO: 954
  Synthetic polynucleotide

SEQ ID NO: 5742 - DNA, 48 bp, Artificial Sequence; identical to SEQ ID NO: 955
  Synthetic polynucleotide

SEQ ID NO: 5743 - DNA, 32 bp, Artificial Sequence; identical to SEQ ID NO: 956
  Synthetic polynucleotide

SEQ ID NO: 5744 - DNA, 32 bp, Artificial Sequence; identical to SEQ ID NO: 957
  Synthetic polynucleotide

SEQ ID NO: 5745 - DNA, 16 bp, Artificial Sequence
  Synthetic polynucleotide
cggtacattttttttt

SEQ ID NO: 5746 - DNA, 48 bp, Artificial Sequence; identical to SEQ ID NO: 959
  Synthetic polynucleotide

SEQ ID NO: 5747 - DNA, 48 bp, Artificial Sequence; identical to SEQ ID NO: 960
  Synthetic polynucleotide

SEQ ID NO: 5748 - DNA, 48 bp, Artificial Sequence; identical to SEQ ID NO: 961
  Synthetic polynucleotide

SEQ ID NO: 5749 - DNA, 32 bp, Artificial Sequence; identical to SEQ ID NO: 419
  Synthetic polynucleotide

SEQ ID NO: 5750 - DNA, 48 bp, Artificial Sequence; identical to SEQ ID NO: 963
  Synthetic polynucleotide

SEQ ID NO: 5751 - DNA, 32 bp, Artificial Sequence; identical to SEQ ID NO: 422
  Synthetic polynucleotide

SEQ ID NO: 5752 - DNA, 48 bp, Artificial Sequence; identical to SEQ ID NO: 965
  Synthetic polynucleotide

SEQ ID NO: 5753 - DNA, 32 bp, Artificial Sequence; identical to SEQ ID NO: 966
  Synthetic polynucleotide

SEQ ID NO: 5754 - DNA, 48 bp, Artificial Sequence; identical to SEQ ID NO: 967
  Synthetic polynucleotide

SEQ ID NO: 5755 - DNA, 32 bp, Artificial Sequence; identical to SEQ ID NO: 968
  Synthetic polynucleotide

SEQ ID NO: 5756 - DNA, 48 bp, Artificial Sequence; identical to SEQ ID NO: 969
  Synthetic polynucleotide

SEQ ID NO: 5757 - DNA, 32 bp, Artificial Sequence; identical to SEQ ID NO: 970
  Synthetic polynucleotide

SEQ ID NO: 5758 - DNA, 48 bp, Artificial Sequence; identical to SEQ ID NO: 971
  Synthetic polynucleotide

SEQ ID NO: 5759 - DNA, 48 bp, Artificial Sequence; identical to SEQ ID NO: 972
  Synthetic polynucleotide

SEQ ID NO: 5760 - DNA, 48 bp, Artificial Sequence; identical to SEQ ID NO: 973
  Synthetic polynucleotide

SEQ ID NO: 5761 - DNA, 48 bp, Artificial Sequence; identical to SEQ ID NO: 974
  Synthetic polynucleotide

SEQ ID NO: 5762 - DNA, 16 bp, Artificial Sequence
  Synthetic polynucleotide
ttttttttatagcatc

SEQ ID NO: 5763 - DNA, 32 bp, Artificial Sequence; identical to SEQ ID NO: 976
  Synthetic polynucleotide

SEQ ID NO: 5764 - DNA, 48 bp, Artificial Sequence; identical to SEQ ID NO: 977
  Synthetic polynucleotide

SEQ ID NO: 5765 - DNA, 32 bp, Artificial Sequence; identical to SEQ ID NO: 978
  Synthetic polynucleotide

SEQ ID NO: 5766 - DNA, 48 bp, Artificial Sequence; identical to SEQ ID NO: 979
  Synthetic polynucleotide

SEQ ID NO: 5767 - DNA, 32 bp, Artificial Sequence; identical to SEQ ID NO: 980
  Synthetic polynucleotide

SEQ ID NO: 5768 - DNA, 48 bp, Artificial Sequence; identical to SEQ ID NO: 981
  Synthetic polynucleotide

SEQ ID NO: 5769 - DNA, 32 bp, Artificial Sequence; identical to SEQ ID NO: 982
  Synthetic polynucleotide

SEQ ID NO: 5770 - DNA, 32 bp, Artificial Sequence; identical to SEQ ID NO: 983
  Synthetic polynucleotide

SEQ ID NO: 5771 - DNA, 16 bp, Artificial Sequence
  Synthetic polynucleotide
cgaatagctttttttt

SEQ ID NO: 5772 - DNA, 48 bp, Artificial Sequence; identical to SEQ ID NO: 985
  Synthetic polynucleotide

SEQ ID NO: 5773 - DNA, 48 bp, Artificial Sequence; identical to SEQ ID NO: 986
  Synthetic polynucleotide

SEQ ID NO: 5774 - DNA, 48 bp, Artificial Sequence; identical to SEQ ID NO: 987
  Synthetic polynucleotide

SEQ ID NO: 5775 - DNA, 32 bp, Artificial Sequence; identical to SEQ ID NO: 988
  Synthetic polynucleotide

SEQ ID NO: 5776 - DNA, 48 bp, Artificial Sequence; identical to SEQ ID NO: 989
  Synthetic polynucleotide

SEQ ID NO: 5777 - DNA, 32 bp, Artificial Sequence; identical to SEQ ID NO: 990
  Synthetic polynucleotide

SEQ ID NO: 5778 - DNA, 48 bp, Artificial Sequence; identical to SEQ ID NO: 991
  Synthetic polynucleotide

SEQ ID NO: 5779 - DNA, 32 bp, Artificial Sequence; identical to SEQ ID NO: 992
  Synthetic polynucleotide

SEQ ID NO: 5780 - DNA, 48 bp, Artificial Sequence; identical to SEQ ID NO: 993
  Synthetic polynucleotide

SEQ ID NO: 5781 - DNA, 32 bp, Artificial Sequence; identical to SEQ ID NO: 994
  Synthetic polynucleotide

SEQ ID NO: 5782 - DNA, 48 bp, Artificial Sequence; identical to SEQ ID NO: 995
  Synthetic polynucleotide

SEQ ID NO: 5783 - DNA, 32 bp, Artificial Sequence; identical to SEQ ID NO: 996
  Synthetic polynucleotide

SEQ ID NO: 5784 - DNA, 48 bp, Artificial Sequence; identical to SEQ ID NO: 997
  Synthetic polynucleotide

SEQ ID NO: 5785 - DNA, 48 bp, Artificial Sequence; identical to SEQ ID NO: 998
  Synthetic polynucleotide

SEQ ID NO: 5786 - DNA, 48 bp, Artificial Sequence; identical to SEQ ID NO: 999
  Synthetic polynucleotide

SEQ ID NO: 5787 - DNA, 48 bp, Artificial Sequence; identical to SEQ ID NO: 1000
  Synthetic polynucleotide

SEQ ID NO: 5788 - DNA, 16 bp, Artificial Sequence
  Synthetic polynucleotide
tttttttttagcagaa

SEQ ID NO: 5789 - DNA, 32 bp, Artificial Sequence; identical to SEQ ID NO: 1002
  Synthetic polynucleotide

SEQ ID NO: 5790 - DNA, 48 bp, Artificial Sequence; identical to SEQ ID NO: 1003
  Synthetic polynucleotide

SEQ ID NO: 5791 - DNA, 32 bp, Artificial Sequence; identical to SEQ ID NO: 1004
  Synthetic polynucleotide

SEQ ID NO: 5792 - DNA, 48 bp, Artificial Sequence; identical to SEQ ID NO: 1005
  Synthetic polynucleotide

SEQ ID NO: 5793 - DNA, 32 bp, Artificial Sequence; identical to SEQ ID NO: 1006
  Synthetic polynucleotide

SEQ ID NO: 5794 - DNA, 48 bp, Artificial Sequence; identical to SEQ ID NO: 1007
  Synthetic polynucleotide

SEQ ID NO: 5795 - DNA, 32 bp, Artificial Sequence; identical to SEQ ID NO: 1008
  Synthetic polynucleotide

SEQ ID NO: 5796 - DNA, 32 bp, Artificial Sequence; identical to SEQ ID NO: 1009
  Synthetic polynucleotide

SEQ ID NO: 5797 - DNA, 16 bp, Artificial Sequence
  Synthetic polynucleotide
tgtccgcgtttttttt

SEQ ID NO: 5798 - DNA, 48 bp, Artificial Sequence; identical to SEQ ID NO: 1011
  Synthetic polynucleotide

SEQ ID NO: 5799 - DNA, 48 bp, Artificial Sequence; identical to SEQ ID NO: 1012
  Synthetic polynucleotide

SEQ ID NO: 5800 - DNA, 48 bp, Artificial Sequence; identical to SEQ ID NO: 1013
  Synthetic polynucleotide

SEQ ID NO: 5801 - DNA, 32 bp, Artificial Sequence; identical to SEQ ID NO: 1014
  Synthetic polynucleotide

SEQ ID NO: 5802 - DNA, 48 bp, Artificial Sequence; identical to SEQ ID NO: 1015
  Synthetic polynucleotide

SEQ ID NO: 5803 - DNA, 32 bp, Artificial Sequence; identical to SEQ ID NO: 1016
  Synthetic polynucleotide

SEQ ID NO: 5804 - DNA, 48 bp, Artificial Sequence; identical to SEQ ID NO: 1017
  Synthetic polynucleotide

SEQ ID NO: 5805 - DNA, 32 bp, Artificial Sequence; identical to SEQ ID NO: 1018
  Synthetic polynucleotide

SEQ ID NO: 5806 - DNA, 48 bp, Artificial Sequence; identical to SEQ ID NO: 1019
  Synthetic polynucleotide

SEQ ID NO: 5807 - DNA, 32 bp, Artificial Sequence; identical to SEQ ID NO: 1020
  Synthetic polynucleotide

SEQ ID NO: 5808 - DNA, 48 bp, Artificial Sequence; identical to SEQ ID NO: 1021
  Synthetic polynucleotide

SEQ ID NO: 5809 - DNA, 32 bp, Artificial Sequence; identical to SEQ ID NO: 1022
  Synthetic polynucleotide

SEQ ID NO: 5810 - DNA, 48 bp, Artificial Sequence; identical to SEQ ID NO: 1023
  Synthetic polynucleotide

SEQ ID NO: 5811 - DNA, 48 bp, Artificial Sequence; identical to SEQ ID NO: 1024
  Synthetic polynucleotide

SEQ ID NO: 5812 - DNA, 48 bp, Artificial Sequence; identical to SEQ ID NO: 1025
  Synthetic polynucleotide

SEQ ID NO: 5813 - DNA, 48 bp, Artificial Sequence; identical to SEQ ID NO: 1026
  Synthetic polynucleotide

SEQ ID NO: 5814 - DNA, 16 bp, Artificial Sequence
  Synthetic polynucleotide
ttttttttgggcgtaa

SEQ ID NO: 5815 - DNA, 32 bp, Artificial Sequence; identical to SEQ ID NO: 1028
  Synthetic polynucleotide

SEQ ID NO: 5816 - DNA, 48 bp, Artificial Sequence; identical to SEQ ID NO: 1029
  Synthetic polynucleotide

SEQ ID NO: 5817 - DNA, 32 bp, Artificial Sequence; identical to SEQ ID NO: 1030
  Synthetic polynucleotide

SEQ ID NO: 5818 - DNA, 48 bp, Artificial Sequence; identical to SEQ ID NO: 1031
  Synthetic polynucleotide

SEQ ID NO: 5819 - DNA, 32 bp, Artificial Sequence; identical to SEQ ID NO: 1032
  Synthetic polynucleotide

SEQ ID NO: 5820 - DNA, 48 bp, Artificial Sequence; identical to SEQ ID NO: 1033
  Synthetic polynucleotide

SEQ ID NO: 5821 - DNA, 32 bp, Artificial Sequence; identical to SEQ ID NO: 1034
  Synthetic polynucleotide

SEQ ID NO: 5822 - DNA, 32 bp, Artificial Sequence; identical to SEQ ID NO: 1035
  Synthetic polynucleotide

SEQ ID NO: 5823 - DNA, 16 bp, Artificial Sequence
  Synthetic polynucleotide
tataaaattttttttt

SEQ ID NO: 5824 - DNA, 48 bp, Artificial Sequence; identical to SEQ ID NO: 1037
  Synthetic polynucleotide

SEQ ID NO: 5825 - DNA, 48 bp, Artificial Sequence; identical to SEQ ID NO: 1038
  Synthetic polynucleotide

SEQ ID NO: 5826 - DNA, 48 bp, Artificial Sequence; identical to SEQ ID NO: 1039
  Synthetic polynucleotide

SEQ ID NO: 5827 - DNA, 32 bp, Artificial Sequence; identical to SEQ ID NO: 1040
  Synthetic polynucleotide

SEQ ID NO: 5828 - DNA, 48 bp, Artificial Sequence
  Synthetic polynucleotide
atgtgtaatttttttttttttttttggtgggcggacgatatctgcgcc

SEQ ID NO: 5829 - DNA, 32 bp, Artificial Sequence; identical to SEQ ID NO: 2051
  Synthetic polynucleotide

SEQ ID NO: 5830 - DNA, 48 bp, Artificial Sequence
  Synthetic polynucleotide
ttggagtgatgaacaacctgggtcctgctgccgccctttggggttcac

SEQ ID NO: 5831 - DNA, 32 bp, Artificial Sequence
  Synthetic polynucleotide
gcccgcgcataacctaagtaatgtctagtgcc

SEQ ID NO: 5832 - DNA, 48 bp, Artificial Sequence
  Synthetic polynucleotide
gtatgtgaaagagtcaagcgtaaagtcttgacgtattccatccagctg

SEQ ID NO: 5833 - DNA, 32 bp, Artificial Sequence
  Synthetic polynucleotide
acggtatggaaagaagcgaaggggctcgagtc

SEQ ID NO: 5834 - DNA, 48 bp, Artificial Sequence
  Synthetic polynucleotide
tacagcagagctacgcgtcccacgtctttaaatgtcccgtgttagggc

SEQ ID NO: 5835 - DNA, 32 bp, Artificial Sequence
  Synthetic polynucleotide
tcgcatctcgtggaatccattcagttcacagg

SEQ ID NO: 5836 - DNA, 48 bp, Artificial Sequence
  Synthetic polynucleotide
cccttagccgtacaaagcgttactttttttttttttttttgacccgct

SEQ ID NO: 5837 - DNA, 48 bp, Artificial Sequence
  Synthetic polynucleotide
gcaggtaaatgcaaaactatgtctttctgaggaggagcagtttgggtc

SEQ ID NO: 5838 - DNA, 48 bp, Artificial Sequence; identical to SEQ ID NO: 2061
  Synthetic polynucleotide

SEQ ID NO: 5839 - DNA, 48 bp, Artificial Sequence
  Synthetic polynucleotide
ggatattctccgccggcaagtaagcagggcgtaaaagcagtcaaccgg

SEQ ID NO: 5840 - DNA, 16 bp, Artificial Sequence
  Synthetic polynucleotide
ttttttttcgacgagt

SEQ ID NO: 5841 - DNA, 32 bp, Artificial Sequence
  Synthetic polynucleotide
aacggcatttttttttttttttttcttccgac

SEQ ID NO: 5842 - DNA, 48 bp, Artificial Sequence
  Synthetic polynucleotide
tttttataactgctgggtgggcgcgagaccaggcgtccggcactgtgt

SEQ ID NO: 5843 - DNA, 32 bp, Artificial Sequence
  Synthetic polynucleotide
ggacgtttgagcaatagaaattgatatgagtt

SEQ ID NO: 5844 - DNA, 48 bp, Artificial Sequence
  Synthetic polynucleotide
accctgcaatcggctcaagacgtagaatgagcgacgcacctgataatt

SEQ ID NO: 5845 - DNA, 32 bp, Artificial Sequence
  Synthetic polynucleotide
aacactccatgcggagaggtaggcagcgtcgc

SEQ ID NO: 5846 - DNA, 48 bp, Artificial Sequence
  Synthetic polynucleotide
ttaaagtgtgtccaagacaacatgactacagttgaccgggggtgcaaa

SEQ ID NO: 5847 - DNA, 32 bp, Artificial Sequence
  Synthetic polynucleotide
aagcgcaacggcgccgattgatcaatggttaa

SEQ ID NO: 5848 - DNA, 32 bp, Artificial Sequence
  Synthetic polynucleotide
gtataggtccttgttacgatggcagcaatatt

SEQ ID NO: 5849 - DNA, 16 bp, Artificial Sequence
  Synthetic polynucleotide
cggacctttttttttt

SEQ ID NO: 5850 - DNA, 48 bp, Artificial Sequence
  Synthetic polynucleotide
ccaccgggtctgttccattgagcaggaatactcagccttcaccgcggg

SEQ ID NO: 5851 - DNA, 48 bp, Artificial Sequence
  Synthetic polynucleotide
tctctatcgtacacatctctggctttaccaagccactaacgggacagt

SEQ ID NO: 5852 - DNA, 48 bp, Artificial Sequence
  Synthetic polynucleotide
cggaacatgcacgatgtccgggatgggtgccaccgcaacctttacgtg

SEQ ID NO: 5853 - DNA, 32 bp, Artificial Sequence; identical to SEQ ID NO: 2076
  Synthetic polynucleotide

SEQ ID NO: 5854 - DNA, 48 bp, Artificial Sequence
  Synthetic polynucleotide
agcaatatttttttttttttttttcacggacaggaacaacgggtgtca

SEQ ID NO: 5855 - DNA, 32 bp, Artificial Sequence; identical to SEQ ID NO: 4057
  Synthetic polynucleotide

SEQ ID NO: 5856 - DNA, 48 bp, Artificial Sequence
  Synthetic polynucleotide
tgtgtatgctcacttttctggcgccggcttagccgtcacgcattgtgg

SEQ ID NO: 5857 - DNA, 32 bp, Artificial Sequence
  Synthetic polynucleotide
ttcgccgcgtcgttttctcagtttaagattca

SEQ ID NO: 5858 - DNA, 48 bp, Artificial Sequence; identical to SEQ ID NO: 2080
  Synthetic polynucleotide

SEQ ID NO: 5859 - DNA, 32 bp, Artificial Sequence; identical to SEQ ID NO: 4540
  Synthetic polynucleotide

SEQ ID NO: 5860 - DNA, 48 bp, Artificial Sequence
  Synthetic polynucleotide
ttaagatgtgtggcaatacaatatagttatatcctcatgtaacggtcg

SEQ ID NO: 5861 - DNA, 32 bp, Artificial Sequence
  Synthetic polynucleotide
tatccgcctatctcgcagagttctaccagcca

SEQ ID NO: 5862 - DNA, 48 bp, Artificial Sequence
  Synthetic polynucleotide
agagagtcgcagcccttcatcgtattttttttttttttttggacatca

SEQ ID NO: 5863 - DNA, 48 bp, Artificial Sequence
  Synthetic polynucleotide
catctctgcctcgacgtacgcgggcaatggaggtgggcgcaaaccgtt

SEQ ID NO: 5864 - DNA, 48 bp, Artificial Sequence
  Synthetic polynucleotide
accacacttgtcccgattcaacttttaaacagttgaaggtttgaacca

SEQ ID NO: 5865 - DNA, 48 bp, Artificial Sequence
  Synthetic polynucleotide
gtagagtcgtagacgattccttgattcccaggttattgagacctatct

SEQ ID NO: 5866 - DNA, 16 bp, Artificial Sequence
  Synthetic polynucleotide
tttttttttcgtgcga

SEQ ID NO: 5867 - DNA, 32 bp, Artificial Sequence
  Synthetic polynucleotide
atgtactcttttttttttttttttgttcacaa

SEQ ID NO: 5868 - DNA, 48 bp, Artificial Sequence
  Synthetic polynucleotide
gctggctatagtacagtgggagtgatcacgctctacagcaccgtgatg

SEQ ID NO: 5869 - DNA, 32 bp, Artificial Sequence
  Synthetic polynucleotide
agacttcgtgcgttcgacgcctgcttccgtgg

SEQ ID NO: 5870 - DNA, 48 bp, Artificial Sequence
  Synthetic polynucleotide
ccccgcaaccgcatcgctgagggggaggggatagcatacccagcacaa

SEQ ID NO: 5871 - DNA, 32 bp, Artificial Sequence
  Synthetic polynucleotide
accctcgcgggtgatcggccgttagtcgtaat

SEQ ID NO: 5872 - DNA, 48 bp, Artificial Sequence
  Synthetic polynucleotide
gtgctgtgttctatcgatctccttcgcaacaaaatgcaaaaccatgtt

SEQ ID NO: 5873 - DNA, 32 bp, Artificial Sequence
  Synthetic polynucleotide
gaaattgtgctgccgacacgaggcacacggcg

SEQ ID NO: 5874 - DNA, 32 bp, Artificial Sequence
  Synthetic polynucleotide
tcagcgatcgcatctacctagcaataagacaa

SEQ ID NO: 5875 - DNA, 16 bp, Artificial Sequence
  Synthetic polynucleotide
gtagaacatttttttt

SEQ ID NO: 5876 - DNA, 48 bp, Artificial Sequence; identical to SEQ ID NO: 2099
  Synthetic polynucleotide

SEQ ID NO: 5877 - DNA, 48 bp, Artificial Sequence; identical to SEQ ID NO: 2100
  Synthetic polynucleotide

SEQ ID NO: 5878 - DNA, 48 bp, Artificial Sequence; identical to SEQ ID NO: 2101
  Synthetic polynucleotide

SEQ ID NO: 5879 - DNA, 32 bp, Artificial Sequence; identical to SEQ ID NO: 2102
  Synthetic polynucleotide

SEQ ID NO: 5880 - DNA, 48 bp, Artificial Sequence
  Synthetic polynucleotide
aaatactgttttttttttttttttcccacggtattaggcactccataa

SEQ ID NO: 5881 - DNA, 32 bp, Artificial Sequence; identical to SEQ ID NO: 3998
  Synthetic polynucleotide

SEQ ID NO: 5882 - DNA, 48 bp, Artificial Sequence
  Synthetic polynucleotide
taccctccctctgcggcgcgaccacattggcactataagactactcca

SEQ ID NO: 5883 - DNA, 32 bp, Artificial Sequence
  Synthetic polynucleotide
accacctgttgaccgatccagagctaagaaaa

SEQ ID NO: 5884 - DNA, 48 bp, Artificial Sequence
  Synthetic polynucleotide
cctcgtgatatcagaggtcgtaactcggtcgcggtatgcattggctca

SEQ ID NO: 5885 - DNA, 32 bp, Artificial Sequence; identical to SEQ ID NO: 4147
  Synthetic polynucleotide

SEQ ID NO: 5886 - DNA, 48 bp, Artificial Sequence
  Synthetic polynucleotide
tagactcagcgtgaggtatgggcctcatcccctgttaaaacccacagg

SEQ ID NO: 5887 - DNA, 32 bp, Artificial Sequence
  Synthetic polynucleotide
tgacgcagcatgtatgtactcatcagcaccta

SEQ ID NO: 5888 - DNA, 48 bp, Artificial Sequence
  Synthetic polynucleotide
aacttcggggcgcattgtaagatattttttttttttttttctataggg

SEQ ID NO: 5889 - DNA, 48 bp, Artificial Sequence
  Synthetic polynucleotide
cacattagagtgttgcacatgatcgatgggaagctaggagagctagct

SEQ ID NO: 5890 - DNA, 48 bp, Artificial Sequence; identical to SEQ ID NO: 1223
  Synthetic polynucleotide

SEQ ID NO: 5891 - DNA, 48 bp, Artificial Sequence
  Synthetic polynucleotide
attctgacctatatacaaataaactaacgtgactagtatacgctccga

SEQ ID NO: 5892 - DNA, 16 bp, Artificial Sequence
  Synthetic polynucleotide
ttttttttgcgcgcag

SEQ ID NO: 5893 - DNA, 32 bp, Artificial Sequence
  Synthetic polynucleotide
aacgacaattttttttttttttttacgaatcc

SEQ ID NO: 5894 - DNA, 48 bp, Artificial Sequence
  Synthetic polynucleotide
tcgtggaacccatgcagaaagataaagtccgtgtcggtaggcgatggt

SEQ ID NO: 5895 - DNA, 32 bp, Artificial Sequence
  Synthetic polynucleotide
gatgggaaataggtaactgggtttgatatttc

SEQ ID NO: 5896 - DNA, 48 bp, Artificial Sequence
  Synthetic polynucleotide
aaggacaccgccctgacgtagaacaagcagagcattttgatcattagg

SEQ ID NO: 5897 - DNA, 32 bp, Artificial Sequence
  Synthetic polynucleotide
gtccaccgcggcgatttaatttgttgcctgcc

SEQ ID NO: 5898 - DNA, 48 bp, Artificial Sequence
  Synthetic polynucleotide
ggtgtgagcgtgggtcttagagttgactgcctcattaatatccgcata

SEQ ID NO: 5899 - DNA, 32 bp, Artificial Sequence
  Synthetic polynucleotide
aggattaacagtgtcatcggtacagccagggt

SEQ ID NO: 5900 - DNA, 32 bp, Artificial Sequence
  Synthetic polynucleotide
tatccggtcgacatcgaccgttcacgtaatgt

SEQ ID NO: 5901 - DNA, 16 bp, Artificial Sequence
  Synthetic polynucleotide
tccactcgtttttttt

SEQ ID NO: 5902 - DNA, 48 bp, Artificial Sequence
  Synthetic polynucleotide
caatccattacggacagtatcatccgagtgtatcgacacggtgataga

SEQ ID NO: 5903 - DNA, 48 bp, Artificial Sequence
  Synthetic polynucleotide
tcctcgcacccattaaaagccaagcggtcacttcccagtacttatcta

SEQ ID NO: 5904 - DNA, 48 bp, Artificial Sequence
  Synthetic polynucleotide
tagtgctagtagtttcctccgaaacccttatcagcagtaatgtgaggg

SEQ ID NO: 5905 - DNA, 32 bp, Artificial Sequence
  Synthetic polynucleotide
agtaccagtgccaaaatgaacttcaatgtaaa

SEQ ID NO: 5906 - DNA, 48 bp, Artificial Sequence
  Synthetic polynucleotide
tgtctcccttttttttttttttttctcccatcactgttacccgcgctg

SEQ ID NO: 5907 - DNA, 32 bp, Artificial Sequence
  Synthetic polynucleotide
gaatcataacccgaaaaagggccaggagtgtt

SEQ ID NO: 5908 - DNA, 48 bp, Artificial Sequence
  Synthetic polynucleotide
tacatctcgctcgtcctcaccataatccaccaaaggtaatgtgaaact

SEQ ID NO: 5909 - DNA, 32 bp, Artificial Sequence
  Synthetic polynucleotide
caatgatatgacggatgtgctcttgagcggtg

SEQ ID NO: 5910 - DNA, 48 bp, Artificial Sequence; identical to SEQ ID NO: 1243
  Synthetic polynucleotide

SEQ ID NO: 5911 - DNA, 32 bp, Artificial Sequence; identical to SEQ ID NO: 4906
  Synthetic polynucleotide

SEQ ID NO: 5912 - DNA, 48 bp, Artificial Sequence
  Synthetic polynucleotide
gtaatgcgaaaccaggagcctattcatcaagggaaagatcataacgtt

SEQ ID NO: 5913 - DNA, 32 bp, Artificial Sequence
  Synthetic polynucleotide
gggatttgttccgcctagctcattctcggtcc

SEQ ID NO: 5914 - DNA, 48 bp, Artificial Sequence
  Synthetic polynucleotide
aattcgagcatgtccccgacctctttttttttttttttttagatccca

SEQ ID NO: 5915 - DNA, 48 bp, Artificial Sequence
  Synthetic polynucleotide
atgttaggagctaacagacccgacactcgcctgtttccgtgcgttctt

SEQ ID NO: 5916 - DNA, 48 bp, Artificial Sequence; identical to SEQ ID NO: 1249
  Synthetic polynucleotide

SEQ ID NO: 5917 - DNA, 48 bp, Artificial Sequence
  Synthetic polynucleotide
caatccctagccgttcaagaatggtctacatcgtaatgaaggatagat

SEQ ID NO: 5918 - DNA, 16 bp, Artificial Sequence
  Synthetic polynucleotide
ttttttttttctagcc

SEQ ID NO: 5919 - DNA, 32 bp, Artificial Sequence
  Synthetic polynucleotide
actggcacttttttttttttttttgctggtaa

SEQ ID NO: 5920 - DNA, 48 bp, Artificial Sequence
  Synthetic polynucleotide
tctgggctattaagctgtggaatgttgttgaacatactccgtcctatc

SEQ ID NO: 5921 - DNA, 32 bp, Artificial Sequence
  Synthetic polynucleotide
ccttactagcggtacacaccaagaaccaatgt

SEQ ID NO: 5922 - DNA, 48 bp, Artificial Sequence
  Synthetic polynucleotide
aagcagatggatctaccggcatgcctcctgaccctttacactccgaaa

SEQ ID NO: 5923 - DNA, 32 bp, Artificial Sequence
  Synthetic polynucleotide
tggaagtgaaactactttaggtgataatctca

SEQ ID NO: 5924 - DNA, 48 bp, Artificial Sequence
  Synthetic polynucleotide
tttttaactgttatatgatatttggggttatacaccgtgtagcttcgc

SEQ ID NO: 5925 - DNA, 32 bp, Artificial Sequence
  Synthetic polynucleotide
aatcttctgctgcctctaggggggtttgtcca

SEQ ID NO: 5926 - DNA, 32 bp, Artificial Sequence
  Synthetic polynucleotide
tgcctgtacaatagtcgtgaccgagcgctagt

SEQ ID NO: 5927 - DNA, 16 bp, Artificial Sequence
  Synthetic polynucleotide
cacgcgaatttttttt

SEQ ID NO: 5928 - DNA, 48 bp, Artificial Sequence
  Synthetic polynucleotide
gggccgacaatcggcgcacctgtatactggaatgttaagcgtaaataa

SEQ ID NO: 5929 - DNA, 48 bp, Artificial Sequence
  Synthetic polynucleotide
cggcagttgtgaaaggagtggcttcctaggtgaacgtgggaaactggt

SEQ ID NO: 5930 - DNA, 48 bp, Artificial Sequence
  Synthetic polynucleotide
ttggtatatcctgatacgcgagcaggggcgtcgaaggctgtctttgtg

SEQ ID NO: 5931 - DNA, 32 bp, Artificial Sequence; identical to SEQ ID NO: 3224
  Synthetic polynucleotide

SEQ ID NO: 5932 - DNA, 48 bp, Artificial Sequence
  Synthetic polynucleotide
tagactttttttttttttttttttgactcagacggatatgctgtagac

SEQ ID NO: 5933 - DNA, 32 bp, Artificial Sequence; identical to SEQ ID NO: 3608
  Synthetic polynucleotide

SEQ ID NO: 5934 - DNA, 48 bp, Artificial Sequence
  Synthetic polynucleotide
gcacgatatgatatgtcgttccttaaggccaaacgcgttttaatgccg

SEQ ID NO: 5935 - DNA, 32 bp, Artificial Sequence
  Synthetic polynucleotide
acatggaacgttatagtttgccaagtttaccc

SEQ ID NO: 5936 - DNA, 48 bp, Artificial Sequence; identical to SEQ ID NO: 1269
  Synthetic polynucleotide

SEQ ID NO: 5937 - DNA, 32 bp, Artificial Sequence; identical to SEQ ID NO: 4028
  Synthetic polynucleotide

SEQ ID NO: 5938 - DNA, 48 bp, Artificial Sequence
  Synthetic polynucleotide
cgcggtgacatgacggccatcgctgataaagggctcttaacaacacta

SEQ ID NO: 5939 - DNA, 32 bp, Artificial Sequence
  Synthetic polynucleotide
tcaactcgtacacactcgtcactagtcgcccg

SEQ ID NO: 5940 - DNA, 48 bp, Artificial Sequence
  Synthetic polynucleotide
aatcaagtagggcgaataccgcaattttttttttttttttatgccccg

SEQ ID NO: 5941 - DNA, 48 bp, Artificial Sequence
  Synthetic polynucleotide
aacaacgtgtctcattcgacataactagccgtgtgataggctctcagc

SEQ ID NO: 5942 - DNA, 48 bp, Artificial Sequence; identical to SEQ ID NO: 1275
  Synthetic polynucleotide

SEQ ID NO: 5943 - DNA, 48 bp, Artificial Sequence
  Synthetic polynucleotide
aacttaaagatcgacgacgagattgtattcgtcaggagtaacccgacc

SEQ ID NO: 5944 - DNA, 16 bp, Artificial Sequence
  Synthetic polynucleotide
ttttttttctccctgt

SEQ ID NO: 5945 - DNA, 32 bp, Artificial Sequence
  Synthetic polynucleotide
cctgttggttttttttttttttttattttcgg

SEQ ID NO: 5946 - DNA, 48 bp, Artificial Sequence
  Synthetic polynucleotide
attttgttagaagtttaactgcaacagagcactacacgccgtcttgac

SEQ ID NO: 5947 - DNA, 32 bp, Artificial Sequence
  Synthetic polynucleotide
atcaaacaaaggctgtttagagtaaagcggat

SEQ ID NO: 5948 - DNA, 48 bp, Artificial Sequence
  Synthetic polynucleotide
tcgagcgtcgcaggggatgggcagcggttaagggcaactgttgtaact

SEQ ID NO: 5949 - DNA, 32 bp, Artificial Sequence
  Synthetic polynucleotide
taatccatcttaatgacccgcttgagtaagga

SEQ ID NO: 5950 - DNA, 48 bp, Artificial Sequence
  Synthetic polynucleotide
cattacactcagtgattccagagcgttaacacagcggagttccttgtt

SEQ ID NO: 5951 - DNA, 32 bp, Artificial Sequence
  Synthetic polynucleotide
ccgacctaaaggagagggcgactgtagacagg

SEQ ID NO: 5952 - DNA, 32 bp, Artificial Sequence
  Synthetic polynucleotide
tattgccgacgtaggcactcaactcggtgaaa

SEQ ID NO: 5953 - DNA, 16 bp, Artificial Sequence
  Synthetic polynucleotide
ccaagatttttttttt

SEQ ID NO: 5954 - DNA, 48 bp, Artificial Sequence
  Synthetic polynucleotide
gttatagaagaatacacattccaatatcgagatccacacaagcaaaga

SEQ ID NO: 5955 - DNA, 48 bp, Artificial Sequence
  Synthetic polynucleotide
tccttggcatagttagtgactaggtttagtttcgcgttagatgttaac

SEQ ID NO: 5956 - DNA, 48 bp, Artificial Sequence
  Synthetic polynucleotide
ttatgcattgcggtacaaccgataacctggtgtaaagcgagtaacgac

SEQ ID NO: 5957 - DNA, 32 bp, Artificial Sequence; identical to SEQ ID NO: 3756
  Synthetic polynucleotide

SEQ ID NO: 5958 - DNA, 48 bp, Artificial Sequence
  Synthetic polynucleotide
ggttaagtttttttttttttttttttgacatctaaattaaccacctgc

SEQ ID NO: 5959 - DNA, 32 bp, Artificial Sequence; identical to SEQ ID NO: 3816
  Synthetic polynucleotide

SEQ ID NO: 5960 - DNA, 48 bp, Artificial Sequence
  Synthetic polynucleotide
tccatactagacgggagaaggacttgcaccaactaaagacggggttga

SEQ ID NO: 5961 - DNA, 32 bp, Artificial Sequence
  Synthetic polynucleotide
gagggctgtgcaaagagaccttcctcacattt

SEQ ID NO: 5962 - DNA, 48 bp, Artificial Sequence; identical to SEQ ID NO: 1295
  Synthetic polynucleotide

SEQ ID NO: 5963 - DNA, 32 bp, Artificial Sequence; identical to SEQ ID NO: 3969
  Synthetic polynucleotide

SEQ ID NO: 5964 - DNA, 48 bp, Artificial Sequence
  Synthetic polynucleotide
cttacactttcgggagaaagtaatatgggttgcactaaactatagcaa

SEQ ID NO: 5965 - DNA, 32 bp, Artificial Sequence
  Synthetic polynucleotide
gatcacaaatatggcaacaaagtctgggaggg

SEQ ID NO: 5966 - DNA, 48 bp, Artificial Sequence
  Synthetic polynucleotide
cctcaacatcttgaatgatcctgattttttttttttttttgagattac

SEQ ID NO: 5967 - DNA, 48 bp, Artificial Sequence
  Synthetic polynucleotide
tgatatggtccaaaatgtgcaacgggaaacactgggcccggggtttgt

SEQ ID NO: 5968 - DNA, 48 bp, Artificial Sequence; identical to SEQ ID NO: 1301
  Synthetic polynucleotide

SEQ ID NO: 5969 - DNA, 48 bp, Artificial Sequence
  Synthetic polynucleotide
aggataaggcagtgactgtaatattgggtactataaccatcctggtga

SEQ ID NO: 5970 - DNA, 16 bp, Artificial Sequence
  Synthetic polynucleotide
ttttttttaacgggat

SEQ ID NO: 5971 - DNA, 32 bp, Artificial Sequence
  Synthetic polynucleotide
gggaagggttttttttttttttttggcgtagg

SEQ ID NO: 5972 - DNA, 48 bp, Artificial Sequence
  Synthetic polynucleotide
ggccgcactggaccacgcgctgtgacaggcttcgtcgccgaaatgtag

SEQ ID NO: 5973 - DNA, 32 bp, Artificial Sequence
  Synthetic polynucleotide
ccatgaatttacagcgacgcctcgttctgtca

SEQ ID NO: 5974 - DNA, 48 bp, Artificial Sequence
  Synthetic polynucleotide
atgtctacatccgacctggggggattatgaaaggcgggtgaaaaccag

SEQ ID NO: 5975 - DNA, 32 bp, Artificial Sequence
  Synthetic polynucleotide
cccgacaactcaatcatgctctccttacgaaa

SEQ ID NO: 5976 - DNA, 48 bp, Artificial Sequence
  Synthetic polynucleotide
agcaatcgtcgtaatgttcaatataaatggttgtatattggagtgtgt

SEQ ID NO: 5977 - DNA, 32 bp, Artificial Sequence
  Synthetic polynucleotide
atcggtgtggggtacggtgagcccacagttgt

SEQ ID NO: 5978 - DNA, 32 bp, Artificial Sequence
  Synthetic polynucleotide
gcaaatgatccccagcctccagggccttcgtc

SEQ ID NO: 5979 - DNA, 16 bp, Artificial Sequence
  Synthetic polynucleotide
tgtgagggtttttttt

SEQ ID NO: 5980 - DNA, 48 bp, Artificial Sequence
  Synthetic polynucleotide
ttattggagatgtcggacttctttgcctggaaggaccatgctcgcagt

SEQ ID NO: 5981 - DNA, 48 bp, Artificial Sequence
  Synthetic polynucleotide
ttcatactggtctctaaagccgtgagaggaccgtatgttttggatact

SEQ ID NO: 5982 - DNA, 48 bp, Artificial Sequence
  Synthetic polynucleotide
tttcggcctcagcgggtcactctttgccgcaattctttcaacgggggc

SEQ ID NO: 5983 - DNA, 32 bp, Artificial Sequence; identical to SEQ ID NO: 4490
  Synthetic polynucleotide

SEQ ID NO: 5984 - DNA, 48 bp, Artificial Sequence; identical to SEQ ID NO: 1041
  Synthetic polynucleotide

SEQ ID NO: 5985 - DNA, 48 bp, Artificial Sequence; identical to SEQ ID NO: 1042
  Synthetic polynucleotide

SEQ ID NO: 5986 - DNA, 48 bp, Artificial Sequence; identical to SEQ ID NO: 1043
  Synthetic polynucleotide

SEQ ID NO: 5987 - DNA, 48 bp, Artificial Sequence; identical to SEQ ID NO: 1044
  Synthetic polynucleotide

SEQ ID NO: 5988 - DNA, 16 bp, Artificial Sequence
  Synthetic polynucleotide
taacctggataggaca

SEQ ID NO: 5989 - DNA, 48 bp, Artificial Sequence; identical to SEQ ID NO: 1046
  Synthetic polynucleotide

SEQ ID NO: 5990 - DNA, 48 bp, Artificial Sequence; identical to SEQ ID NO: 1047
  Synthetic polynucleotide

SEQ ID NO: 5991 - DNA, 48 bp, Artificial Sequence; identical to SEQ ID NO: 1048
  Synthetic polynucleotide

SEQ ID NO: 5992 - DNA, 48 bp, Artificial Sequence; identical to SEQ ID NO: 1049
  Synthetic polynucleotide

SEQ ID NO: 5993 - DNA, 16 bp, Artificial Sequence
  Synthetic polynucleotide
tagcccgggttccggt

SEQ ID NO: 5994 - DNA, 32 bp, Artificial Sequence; identical to SEQ ID NO: 1051
  Synthetic polynucleotide

SEQ ID NO: 5995 - DNA, 48 bp, Artificial Sequence; identical to SEQ ID NO: 1052
  Synthetic polynucleotide

SEQ ID NO: 5996 - DNA, 32 bp, Artificial Sequence; identical to SEQ ID NO: 1053
  Synthetic polynucleotide

SEQ ID NO: 5997 - DNA, 48 bp, Artificial Sequence; identical to SEQ ID NO: 1054
  Synthetic polynucleotide

SEQ ID NO: 5998 - DNA, 32 bp, Artificial Sequence; identical to SEQ ID NO: 1055
  Synthetic polynucleotide

SEQ ID NO: 5999 - DNA, 48 bp, Artificial Sequence; identical to SEQ ID NO: 1056
  Synthetic polynucleotide

SEQ ID NO: 6000 - DNA, 32 bp, Artificial Sequence; identical to SEQ ID NO: 1057
  Synthetic polynucleotide

SEQ ID NO: 6001 - DNA, 32 bp, Artificial Sequence; identical to SEQ ID NO: 1058
  Synthetic polynucleotide

SEQ ID NO: 6002 - DNA, 32 bp, Artificial Sequence; identical to SEQ ID NO: 1059
  Synthetic polynucleotide

SEQ ID NO: 6003 - DNA, 48 bp, Artificial Sequence; identical to SEQ ID NO: 1060
  Synthetic polynucleotide

SEQ ID NO: 6004 - DNA, 32 bp, Artificial Sequence; identical to SEQ ID NO: 1061
  Synthetic polynucleotide

SEQ ID NO: 6005 - DNA, 48 bp, Artificial Sequence; identical to SEQ ID NO: 1062
  Synthetic polynucleotide

SEQ ID NO: 6006 - DNA, 32 bp, Artificial Sequence; identical to SEQ ID NO: 1063
  Synthetic polynucleotide

SEQ ID NO: 6007 - DNA, 48 bp, Artificial Sequence; identical to SEQ ID NO: 1064
  Synthetic polynucleotide

SEQ ID NO: 6008 - DNA, 32 bp, Artificial Sequence; identical to SEQ ID NO: 1065
  Synthetic polynucleotide

SEQ ID NO: 6009 - DNA, 32 bp, Artificial Sequence; identical to SEQ ID NO: 1066
  Synthetic polynucleotide

SEQ ID NO: 6010 - DNA, 32 bp, Artificial Sequence; identical to SEQ ID NO: 1067
  Synthetic polynucleotide

SEQ ID NO: 6011 - DNA, 32 bp, Artificial Sequence; identical to SEQ ID NO: 1068
  Synthetic polynucleotide

SEQ ID NO: 6012 - DNA, 32 bp, Artificial Sequence; identical to SEQ ID NO: 1069
  Synthetic polynucleotide

SEQ ID NO: 6013 - DNA, 32 bp, Artificial Sequence; identical to SEQ ID NO: 1070
  Synthetic polynucleotide

SEQ ID NO: 6014 - DNA, 32 bp, Artificial Sequence; identical to SEQ ID NO: 1071
  Synthetic polynucleotide

SEQ ID NO: 6015 - DNA, 32 bp, Artificial Sequence; identical to SEQ ID NO: 1072
  Synthetic polynucleotide

SEQ ID NO: 6016 - DNA, 32 bp, Artificial Sequence; identical to SEQ ID NO: 1073
  Synthetic polynucleotide

SEQ ID NO: 6017 - DNA, 32 bp, Artificial Sequence; identical to SEQ ID NO: 1074
  Synthetic polynucleotide

SEQ ID NO: 6018 - DNA, 32 bp, Artificial Sequence; identical to SEQ ID NO: 1075
  Synthetic polynucleotide

SEQ ID NO: 6019 - DNA, 32 bp, Artificial Sequence; identical to SEQ ID NO: 1076
  Synthetic polynucleotide

SEQ ID NO: 6020 - DNA, 32 bp, Artificial Sequence; identical to SEQ ID NO: 1077
  Synthetic polynucleotide

SEQ ID NO: 6021 - DNA, 32 bp, Artificial Sequence; identical to SEQ ID NO: 1078
  Synthetic polynucleotide

SEQ ID NO: 6022 - DNA, 32 bp, Artificial Sequence; identical to SEQ ID NO: 1079
  Synthetic polynucleotide

SEQ ID NO: 6023 - DNA, 32 bp, Artificial Sequence; identical to SEQ ID NO: 1080
  Synthetic polynucleotide

SEQ ID NO: 6024 - DNA, 32 bp, Artificial Sequence; identical to SEQ ID NO: 1081
  Synthetic polynucleotide

SEQ ID NO: 6025 - DNA, 32 bp, Artificial Sequence; identical to SEQ ID NO: 1082
  Synthetic polynucleotide

SEQ ID NO: 6026 - DNA, 32 bp, Artificial Sequence; identical to SEQ ID NO: 1083
  Synthetic polynucleotide

SEQ ID NO: 6027 - DNA, 32 bp, Artificial Sequence; identical to SEQ ID NO: 1084
  Synthetic polynucleotide

SEQ ID NO: 6028 - DNA, 32 bp, Artificial Sequence; identical to SEQ ID NO: 1085
  Synthetic polynucleotide

SEQ ID NO: 6029 - DNA, 32 bp, Artificial Sequence; identical to SEQ ID NO: 1086
  Synthetic polynucleotide

SEQ ID NO: 6030 - DNA, 32 bp, Artificial Sequence; identical to SEQ ID NO: 1087
  Synthetic polynucleotide

SEQ ID NO: 6031 - DNA, 32 bp, Artificial Sequence; identical to SEQ ID NO: 1088
  Synthetic polynucleotide

SEQ ID NO: 6032 - DNA, 32 bp, Artificial Sequence; identical to SEQ ID NO: 1089
  Synthetic polynucleotide

SEQ ID NO: 6033 - DNA, 32 bp, Artificial Sequence; identical to SEQ ID NO: 1090
  Synthetic polynucleotide

SEQ ID NO: 6034 - DNA, 32 bp, Artificial Sequence; identical to SEQ ID NO: 1091
  Synthetic polynucleotide

SEQ ID NO: 6035 - DNA, 32 bp, Artificial Sequence; identical to SEQ ID NO: 1092
  Synthetic polynucleotide

SEQ ID NO: 6036 - DNA, 32 bp, Artificial Sequence; identical to SEQ ID NO: 1093
  Synthetic polynucleotide

SEQ ID NO: 6037 - DNA, 32 bp, Artificial Sequence; identical to SEQ ID NO: 1094
  Synthetic polynucleotide

SEQ ID NO: 6038 - DNA, 32 bp, Artificial Sequence; identical to SEQ ID NO: 1095
  Synthetic polynucleotide

SEQ ID NO: 6039 - DNA, 32 bp, Artificial Sequence; identical to SEQ ID NO: 1096
  Synthetic polynucleotide

SEQ ID NO: 6040 - DNA, 32 bp, Artificial Sequence; identical to SEQ ID NO: 1097
  Synthetic polynucleotide

SEQ ID NO: 6041 - DNA, 32 bp, Artificial Sequence; identical to SEQ ID NO: 1098
  Synthetic polynucleotide

SEQ ID NO: 6042 - DNA, 32 bp, Artificial Sequence; identical to SEQ ID NO: 1099
  Synthetic polynucleotide

SEQ ID NO: 6043 - DNA, 32 bp, Artificial Sequence; identical to SEQ ID NO: 1100
  Synthetic polynucleotide

SEQ ID NO: 6044 - DNA, 32 bp, Artificial Sequence; identical to SEQ ID NO: 1101
  Synthetic polynucleotide

SEQ ID NO: 6045 - DNA, 32 bp, Artificial Sequence; identical to SEQ ID NO: 1102
  Synthetic polynucleotide

SEQ ID NO: 6046 - DNA, 32 bp, Artificial Sequence; identical to SEQ ID NO: 1103
  Synthetic polynucleotide

SEQ ID NO: 6047 - DNA, 32 bp, Artificial Sequence; identical to SEQ ID NO: 1104
  Synthetic polynucleotide

SEQ ID NO: 6048 - DNA, 32 bp, Artificial Sequence; identical to SEQ ID NO: 1105
  Synthetic polynucleotide

SEQ ID NO: 6049 - DNA, 32 bp, Artificial Sequence; identical to SEQ ID NO: 1106
  Synthetic polynucleotide

SEQ ID NO: 6050 - DNA, 32 bp, Artificial Sequence; identical to SEQ ID NO: 1107
  Synthetic polynucleotide

SEQ ID NO: 6051 - DNA, 32 bp, Artificial Sequence; identical to SEQ ID NO: 1108
  Synthetic polynucleotide

SEQ ID NO: 6052 - DNA, 32 bp, Artificial Sequence; identical to SEQ ID NO: 1109
  Synthetic polynucleotide

SEQ ID NO: 6053 - DNA, 32 bp, Artificial Sequence; identical to SEQ ID NO: 1110
  Synthetic polynucleotide

SEQ ID NO: 6054 - DNA, 32 bp, Artificial Sequence; identical to SEQ ID NO: 1111
  Synthetic polynucleotide

SEQ ID NO: 6055 - DNA, 32 bp, Artificial Sequence; identical to SEQ ID NO: 1112
  Synthetic polynucleotide

SEQ ID NO: 6056 - DNA, 32 bp, Artificial Sequence; identical to SEQ ID NO: 1113
  Synthetic polynucleotide

SEQ ID NO: 6057 - DNA, 32 bp, Artificial Sequence; identical to SEQ ID NO: 1114
  Synthetic polynucleotide

SEQ ID NO: 6058 - DNA, 32 bp, Artificial Sequence; identical to SEQ ID NO: 1115
  Synthetic polynucleotide

SEQ ID NO: 6059 - DNA, 32 bp, Artificial Sequence; identical to SEQ ID NO: 1116
  Synthetic polynucleotide

SEQ ID NO: 6060 - DNA, 32 bp, Artificial Sequence; identical to SEQ ID NO: 1117
  Synthetic polynucleotide

SEQ ID NO: 6061 - DNA, 32 bp, Artificial Sequence; identical to SEQ ID NO: 1118
  Synthetic polynucleotide

SEQ ID NO: 6062 - DNA, 32 bp, Artificial Sequence; identical to SEQ ID NO: 1119
  Synthetic polynucleotide

SEQ ID NO: 6063 - DNA, 32 bp, Artificial Sequence; identical to SEQ ID NO: 1120
  Synthetic polynucleotide

SEQ ID NO: 6064 - DNA, 32 bp, Artificial Sequence; identical to SEQ ID NO: 1121
  Synthetic polynucleotide

SEQ ID NO: 6065 - DNA, 32 bp, Artificial Sequence; identical to SEQ ID NO: 1122
  Synthetic polynucleotide

SEQ ID NO: 6066 - DNA, 32 bp, Artificial Sequence; identical to SEQ ID NO: 1123
  Synthetic polynucleotide

SEQ ID NO: 6067 - DNA, 32 bp, Artificial Sequence; identical to SEQ ID NO: 1124
  Synthetic polynucleotide

SEQ ID NO: 6068 - DNA, 32 bp, Artificial Sequence; identical to SEQ ID NO: 1125
  Synthetic polynucleotide

SEQ ID NO: 6069 - DNA, 32 bp, Artificial Sequence; identical to SEQ ID NO: 1126
  Synthetic polynucleotide

SEQ ID NO: 6070 - DNA, 32 bp, Artificial Sequence; identical to SEQ ID NO: 1127
  Synthetic polynucleotide

SEQ ID NO: 6071 - DNA, 32 bp, Artificial Sequence; identical to SEQ ID NO: 1128
  Synthetic polynucleotide

SEQ ID NO: 6072 - DNA, 32 bp, Artificial Sequence; identical to SEQ ID NO: 1129
  Synthetic polynucleotide

SEQ ID NO: 6073 - DNA, 32 bp, Artificial Sequence; identical to SEQ ID NO: 1130
  Synthetic polynucleotide

SEQ ID NO: 6074 - DNA, 32 bp, Artificial Sequence; identical to SEQ ID NO: 1131
  Synthetic polynucleotide

SEQ ID NO: 6075 - DNA, 32 bp, Artificial Sequence; identical to SEQ ID NO: 1132
  Synthetic polynucleotide

SEQ ID NO: 6076 - DNA, 32 bp, Artificial Sequence; identical to SEQ ID NO: 1133
  Synthetic polynucleotide

SEQ ID NO: 6077 - DNA, 32 bp, Artificial Sequence; identical to SEQ ID NO: 1134
  Synthetic polynucleotide

SEQ ID NO: 6078 - DNA, 32 bp, Artificial Sequence; identical to SEQ ID NO: 1135
  Synthetic polynucleotide

SEQ ID NO: 6079 - DNA, 32 bp, Artificial Sequence; identical to SEQ ID NO: 1136
  Synthetic polynucleotide

SEQ ID NO: 6080 - DNA, 32 bp, Artificial Sequence; identical to SEQ ID NO: 1137
  Synthetic polynucleotide

SEQ ID NO: 6081 - DNA, 32 bp, Artificial Sequence; identical to SEQ ID NO: 1138
  Synthetic polynucleotide

SEQ ID NO: 6082 - DNA, 32 bp, Artificial Sequence; identical to SEQ ID NO: 1139
  Synthetic polynucleotide

SEQ ID NO: 6083 - DNA, 32 bp, Artificial Sequence; identical to SEQ ID NO: 1140
  Synthetic polynucleotide

SEQ ID NO: 6084 - DNA, 32 bp, Artificial Sequence; identical to SEQ ID NO: 1141
  Synthetic polynucleotide

SEQ ID NO: 6085 - DNA, 32 bp, Artificial Sequence; identical to SEQ ID NO: 1142
  Synthetic polynucleotide

SEQ ID NO: 6086 - DNA, 32 bp, Artificial Sequence; identical to SEQ ID NO: 1143
  Synthetic polynucleotide

SEQ ID NO: 6087 - DNA, 32 bp, Artificial Sequence; identical to SEQ ID NO: 1144
  Synthetic polynucleotide

SEQ ID NO: 6088 - DNA, 32 bp, Artificial Sequence; identical to SEQ ID NO: 1145
  Synthetic polynucleotide

SEQ ID NO: 6089 - DNA, 32 bp, Artificial Sequence; identical to SEQ ID NO: 1146
  Synthetic polynucleotide

SEQ ID NO: 6090 - DNA, 32 bp, Artificial Sequence; identical to SEQ ID NO: 1147
  Synthetic polynucleotide

SEQ ID NO: 6091 - DNA, 32 bp, Artificial Sequence; identical to SEQ ID NO: 1148
  Synthetic polynucleotide

SEQ ID NO: 6092 - DNA, 32 bp, Artificial Sequence; identical to SEQ ID NO: 1149
  Synthetic polynucleotide

SEQ ID NO: 6093 - DNA, 32 bp, Artificial Sequence; identical to SEQ ID NO: 1150
  Synthetic polynucleotide

SEQ ID NO: 6094 - DNA, 32 bp, Artificial Sequence; identical to SEQ ID NO: 1151
  Synthetic polynucleotide

SEQ ID NO: 6095 - DNA, 32 bp, Artificial Sequence; identical to SEQ ID NO: 1152
  Synthetic polynucleotide

SEQ ID NO: 6096 - DNA, 32 bp, Artificial Sequence; identical to SEQ ID NO: 1153
  Synthetic polynucleotide

SEQ ID NO: 6097 - DNA, 32 bp, Artificial Sequence; identical to SEQ ID NO: 1154
  Synthetic polynucleotide

SEQ ID NO: 6098 - DNA, 32 bp, Artificial Sequence; identical to SEQ ID NO: 1155
  Synthetic polynucleotide

SEQ ID NO: 6099 - DNA, 32 bp, Artificial Sequence; identical to SEQ ID NO: 1156
  Synthetic polynucleotide

SEQ ID NO: 6100 - DNA, 32 bp, Artificial Sequence; identical to SEQ ID NO: 1157
  Synthetic polynucleotide

SEQ ID NO: 6101 - DNA, 32 bp, Artificial Sequence; identical to SEQ ID NO: 1158
  Synthetic polynucleotide

SEQ ID NO: 6102 - DNA, 32 bp, Artificial Sequence; identical to SEQ ID NO: 1159
  Synthetic polynucleotide

SEQ ID NO: 6103 - DNA, 32 bp, Artificial Sequence; identical to SEQ ID NO: 1160
  Synthetic polynucleotide

SEQ ID NO: 6104 - DNA, 32 bp, Artificial Sequence; identical to SEQ ID NO: 1161
  Synthetic polynucleotide

SEQ ID NO: 6105 - DNA, 32 bp, Artificial Sequence; identical to SEQ ID NO: 1162
  Synthetic polynucleotide

SEQ ID NO: 6106 - DNA, 32 bp, Artificial Sequence; identical to SEQ ID NO: 1163
  Synthetic polynucleotide

SEQ ID NO: 6107 - DNA, 32 bp, Artificial Sequence; identical to SEQ ID NO: 1164
  Synthetic polynucleotide

SEQ ID NO: 6108 - DNA, 32 bp, Artificial Sequence; identical to SEQ ID NO: 1165
  Synthetic polynucleotide

SEQ ID NO: 6109 - DNA, 32 bp, Artificial Sequence; identical to SEQ ID NO: 1166
  Synthetic polynucleotide

SEQ ID NO: 6110 - DNA, 32 bp, Artificial Sequence; identical to SEQ ID NO: 1167
  Synthetic polynucleotide

SEQ ID NO: 6111 - DNA, 32 bp, Artificial Sequence; identical to SEQ ID NO: 1168
  Synthetic polynucleotide

SEQ ID NO: 6112 - DNA, 32 bp, Artificial Sequence; identical to SEQ ID NO: 1169
  Synthetic polynucleotide

SEQ ID NO: 6113 - DNA, 32 bp, Artificial Sequence; identical to SEQ ID NO: 1170
  Synthetic polynucleotide

SEQ ID NO: 6114 - DNA, 32 bp, Artificial Sequence; identical to SEQ ID NO: 1171
  Synthetic polynucleotide

SEQ ID NO: 6115 - DNA, 32 bp, Artificial Sequence; identical to SEQ ID NO: 1172
  Synthetic polynucleotide

SEQ ID NO: 6116 - DNA, 32 bp, Artificial Sequence; identical to SEQ ID NO: 1173
  Synthetic polynucleotide

SEQ ID NO: 6117 - DNA, 32 bp, Artificial Sequence; identical to SEQ ID NO: 1174
  Synthetic polynucleotide

SEQ ID NO: 6118 - DNA, 32 bp, Artificial Sequence; identical to SEQ ID NO: 1175
  Synthetic polynucleotide

SEQ ID NO: 6119 - DNA, 32 bp, Artificial Sequence; identical to SEQ ID NO: 1176
  Synthetic polynucleotide

SEQ ID NO: 6120 - DNA, 32 bp, Artificial Sequence; identical to SEQ ID NO: 1177
  Synthetic polynucleotide

SEQ ID NO: 6121 - DNA, 32 bp, Artificial Sequence; identical to SEQ ID NO: 1178
  Synthetic polynucleotide

SEQ ID NO: 6122 - DNA, 32 bp, Artificial Sequence; identical to SEQ ID NO: 1179
  Synthetic polynucleotide

SEQ ID NO: 6123 - DNA, 32 bp, Artificial Sequence; identical to SEQ ID NO: 1180
  Synthetic polynucleotide

SEQ ID NO: 6124 - DNA, 32 bp, Artificial Sequence; identical to SEQ ID NO: 1181
  Synthetic polynucleotide

SEQ ID NO: 6125 - DNA, 32 bp, Artificial Sequence; identical to SEQ ID NO: 1182
  Synthetic polynucleotide

SEQ ID NO: 6126 - DNA, 32 bp, Artificial Sequence; identical to SEQ ID NO: 1183
  Synthetic polynucleotide

SEQ ID NO: 6127 - DNA, 32 bp, Artificial Sequence; identical to SEQ ID NO: 1184
  Synthetic polynucleotide

SEQ ID NO: 6128 - DNA, 32 bp, Artificial Sequence; identical to SEQ ID NO: 1185
  Synthetic polynucleotide

SEQ ID NO: 6129 - DNA, 32 bp, Artificial Sequence; identical to SEQ ID NO: 1186
  Synthetic polynucleotide

SEQ ID NO: 6130 - DNA, 32 bp, Artificial Sequence; identical to SEQ ID NO: 1187
  Synthetic polynucleotide

SEQ ID NO: 6131 - DNA, 32 bp, Artificial Sequence; identical to SEQ ID NO: 1188
  Synthetic polynucleotide

SEQ ID NO: 6132 - DNA, 32 bp, Artificial Sequence; identical to SEQ ID NO: 1189
  Synthetic polynucleotide

SEQ ID NO: 6133 - DNA, 32 bp, Artificial Sequence; identical to SEQ ID NO: 1190
  Synthetic polynucleotide

SEQ ID NO: 6134 - DNA, 32 bp, Artificial Sequence; identical to SEQ ID NO: 1191
  Synthetic polynucleotide

SEQ ID NO: 6135 - DNA, 32 bp, Artificial Sequence; identical to SEQ ID NO: 1192
  Synthetic polynucleotide

SEQ ID NO: 6136 - DNA, 32 bp, Artificial Sequence; identical to SEQ ID NO: 1193
  Synthetic polynucleotide

SEQ ID NO: 6137 - DNA, 32 bp, Artificial Sequence; identical to SEQ ID NO: 1194
  Synthetic polynucleotide

SEQ ID NO: 6138 - DNA, 32 bp, Artificial Sequence
  Synthetic polynucleotide
gcagggtgttcaggctattttataacactcac

SEQ ID NO: 6139 - DNA, 32 bp, Artificial Sequence; identical to SEQ ID NO: 1196
  Synthetic polynucleotide

SEQ ID NO: 6140 - DNA, 32 bp, Artificial Sequence
  Synthetic polynucleotide
gcggtaactcaattttacagtgccacattgta

SEQ ID NO: 6141 - DNA, 32 bp, Artificial Sequence; identical to SEQ ID NO: 1198
  Synthetic polynucleotide

SEQ ID NO: 6142 - DNA, 32 bp, Artificial Sequence
  Synthetic polynucleotide
gagctcaccctctcctgctgtgccctacaact

SEQ ID NO: 6143 - DNA, 32 bp, Artificial Sequence; identical to SEQ ID NO: 1200
  Synthetic polynucleotide

SEQ ID NO: 6144 - DNA, 32 bp, Artificial Sequence
  Synthetic polynucleotide
atagaatgagacgtccccatattaaagcgggt

SEQ ID NO: 6145 - DNA, 32 bp, Artificial Sequence; identical to SEQ ID NO: 1202
  Synthetic polynucleotide

SEQ ID NO: 6146 - DNA, 32 bp, Artificial Sequence
  Synthetic polynucleotide
gaattatattgacctattttttgtctgtatga

SEQ ID NO: 6147 - DNA, 32 bp, Artificial Sequence; identical to SEQ ID NO: 1204
  Synthetic polynucleotide

SEQ ID NO: 6148 - DNA, 32 bp, Artificial Sequence
  Synthetic polynucleotide
gaccacgtttatgtgaatctatgttggtcggt

SEQ ID NO: 6149 - DNA, 32 bp, Artificial Sequence; identical to SEQ ID NO: 1206
  Synthetic polynucleotide

SEQ ID NO: 6150 - DNA, 32 bp, Artificial Sequence
  Synthetic polynucleotide
agttagatatgctgggcgcattcacggacgga

SEQ ID NO: 6151 - DNA, 32 bp, Artificial Sequence; identical to SEQ ID NO: 1208
  Synthetic polynucleotide

SEQ ID NO: 6152 - DNA, 32 bp, Artificial Sequence
  Synthetic polynucleotide
cgtaggagtatccattaaactacacgtcccat

SEQ ID NO: 6153 - DNA, 32 bp, Artificial Sequence; identical to SEQ ID NO: 1210
  Synthetic polynucleotide

SEQ ID NO: 6154 - DNA, 32 bp, Artificial Sequence
  Synthetic polynucleotide
agacaatgttacgcccagtaacgctttgtacg

SEQ ID NO: 6155 - DNA, 32 bp, Artificial Sequence
  Synthetic polynucleotide
taagaacataggtggtagggttcagttcccct

SEQ ID NO: 6156 - DNA, 32 bp, Artificial Sequence
  Synthetic polynucleotide
tagcgccttaacagcaagacatagttttgcat

SEQ ID NO: 6157 - DNA, 32 bp, Artificial Sequence
  Synthetic polynucleotide
ttacgagtataccctacgtttattccccgctc

SEQ ID NO: 6158 - DNA, 32 bp, Artificial Sequence
  Synthetic polynucleotide
ggctccaagatatcgcatcggattaggcctcg

SEQ ID NO: 6159 - DNA, 32 bp, Artificial Sequence
  Synthetic polynucleotide
gatgcgttggttcgtgagtgtttttatcaaag

SEQ ID NO: 6160 - DNA, 32 bp, Artificial Sequence
  Synthetic polynucleotide
cgtagtgggcactaagcttacttgccggcgga

SEQ ID NO: 6161 - DNA, 32 bp, Artificial Sequence; identical to SEQ ID NO: 1215
  Synthetic polynucleotide

SEQ ID NO: 6162 - DNA, 32 bp, Artificial Sequence
  Synthetic polynucleotide
aggtcatctaggcaagttacacatttggggac

SEQ ID NO: 6163 - DNA, 32 bp, Artificial Sequence
  Synthetic polynucleotide
cgaaggtcaggctgcgggtagaaggaactctg

SEQ ID NO: 6164 - DNA, 32 bp, Artificial Sequence
  Synthetic polynucleotide
ggtcagacccaccttacactccaataggttat

SEQ ID NO: 6165 - DNA, 32 bp, Artificial Sequence
  Synthetic polynucleotide
ttgtcgttatgtgaagaatgttctgaggttag

SEQ ID NO: 6166 - DNA, 32 bp, Artificial Sequence
  Synthetic polynucleotide
gctgatgcggtatttttcacataccttctttc

SEQ ID NO: 6167 - DNA, 32 bp, Artificial Sequence
  Synthetic polynucleotide
cgcctccgacctgccataacacttggtctcga

SEQ ID NO: 6168 - DNA, 32 bp, Artificial Sequence
  Synthetic polynucleotide
gcatgagaacctaatgctgctgtaattccacg

SEQ ID NO: 6169 - DNA, 32 bp, Artificial Sequence; identical to SEQ ID NO: 1220
  Synthetic polynucleotide

SEQ ID NO: 6170 - DNA, 32 bp, Artificial Sequence
  Synthetic polynucleotide
tatcgtccgcccaccaaaggtccgagtattcc

SEQ ID NO: 6171 - DNA, 32 bp, Artificial Sequence
  Synthetic polynucleotide
gacccaggggcgcagaactgaaaggcgccgtg

SEQ ID NO: 6172 - DNA, 32 bp, Artificial Sequence
  Synthetic polynucleotide
caaagggcggcagcagcccggtggcttggtaa

SEQ ID NO: 6173 - DNA, 32 bp, Artificial Sequence
  Synthetic polynucleotide
tttacgctgtgaacccgatgatatatcgccaa

SEQ ID NO: 6174 - DNA, 32 bp, Artificial Sequence
  Synthetic polynucleotide
tggaatacgtcaagacgatagagatggcaccc

SEQ ID NO: 6175 - DNA, 32 bp, Artificial Sequence
  Synthetic polynucleotide
cgtgggaccagctggatattgaagggtaatcc

SEQ ID NO: 6176 - DNA, 32 bp, Artificial Sequence
  Synthetic polynucleotide
acgggacatttaaagaatgttccgtcttgtat

SEQ ID NO: 6177 - DNA, 32 bp, Artificial Sequence
  Synthetic polynucleotide
ttttttttgccctaacaggatggctttttttt

SEQ ID NO: 6178 - DNA, 32 bp, Artificial Sequence
  Synthetic polynucleotide
cccgacaaagcgggtcatgccgttccagcagt

SEQ ID NO: 6179 - DNA, 32 bp, Artificial Sequence
  Synthetic polynucleotide
ctgctccttgacaggtgggcacgagcccgacg

SEQ ID NO: 6180 - DNA, 32 bp, Artificial Sequence
  Synthetic polynucleotide
acattactgacccaaaaaacgtccgagccgat

SEQ ID NO: 6181 - DNA, 32 bp, Artificial Sequence
  Synthetic polynucleotide
ggggactcggcactagggtcggcctcgtatta

SEQ ID NO: 6182 - DNA, 32 bp, Artificial Sequence
  Synthetic polynucleotide
ccccttcgtattcttcggagtgttcttggaca

SEQ ID NO: 6183 - DNA, 32 bp, Artificial Sequence
  Synthetic polynucleotide
ctgcttttgactcgagccggcgaagtaatggt

SEQ ID NO: 6184 - DNA, 32 bp, Artificial Sequence
  Synthetic polynucleotide
ctgaatggccggttgattgcgctttaacaagg

SEQ ID NO: 6185 - DNA, 32 bp, Artificial Sequence
  Synthetic polynucleotide
ttttttttcctgtgaatataatagtttttttt

SEQ ID NO: 6186 - DNA, 32 bp, Artificial Sequence
  Synthetic polynucleotide
gcgcccacactcgtcgtacgatgaagggctgc

SEQ ID NO: 6187 - DNA, 32 bp, Artificial Sequence
  Synthetic polynucleotide
ccggacgcctggtctcgctaagggcctcagaa

SEQ ID NO: 6188 - DNA, 32 bp, Artificial Sequence
  Synthetic polynucleotide
tacgtcttacacagtgcccgcgtacgtcgagg

SEQ ID NO: 6189 - DNA, 32 bp, Artificial Sequence
  Synthetic polynucleotide
ggtgcgtcgctcattcttacctgcttagggtc

SEQ ID NO: 6190 - DNA, 32 bp, Artificial Sequence
  Synthetic polynucleotide
catgttgtaattatcaaagttgaatcgggaca

SEQ ID NO: 6191 - DNA, 32 bp, Artificial Sequence
  Synthetic polynucleotide
cccggtcaactgtagtgtgccgtaacgccctg

SEQ ID NO: 6192 - DNA, 32 bp, Artificial Sequence
  Synthetic polynucleotide
tgccatcgtttgcacctcaaggaatcgtctac

SEQ ID NO: 6193 - DNA, 32 bp, Artificial Sequence
  Synthetic polynucleotide
ttttttttaatattgcgaatatcctttttttt

SEQ ID NO: 6194 - DNA, 32 bp, Artificial Sequence
  Synthetic polynucleotide
gaaggctggtcggaagatattgctttgccctt

SEQ ID NO: 6195 - DNA, 32 bp, Artificial Sequence
  Synthetic polynucleotide
tcaatttccccgcggtgtggcgctttgttcat

SEQ ID NO: 6196 - DNA, 32 bp, Artificial Sequence
  Synthetic polynucleotide
gttagtggaactcatacatacacaaaaacgac

SEQ ID NO: 6197 - DNA, 32 bp, Artificial Sequence
  Synthetic polynucleotide
gcctacctactgtcccgcgcgggctgactctt

SEQ ID NO: 6198 - DNA, 32 bp, Artificial Sequence
  Synthetic polynucleotide
ggttgcgggcgacgctcgtcctgtcaaggacg

SEQ ID NO: 6199 - DNA, 32 bp, Artificial Sequence
  Synthetic polynucleotide
tgatcaatcacgtaaacataccgtgcgtagct

SEQ ID NO: 6200 - DNA, 32 bp, Artificial Sequence
  Synthetic polynucleotide
ctgctgaattaaccatcatcttaagcgagata

SEQ ID NO: 6201 - DNA, 32 bp, Artificial Sequence
  Synthetic polynucleotide
ttttttttgagtaaggagatgcgatttttttt

SEQ ID NO: 6202 - DNA, 32 bp, Artificial Sequence
  Synthetic polynucleotide
gttgttcctgtccgtgtgttctacgtagttaa

SEQ ID NO: 6203 - DNA, 32 bp, Artificial Sequence
  Synthetic polynucleotide
gcgccagatgacaccctgctcaatggaacaga

SEQ ID NO: 6204 - DNA, 32 bp, Artificial Sequence
  Synthetic polynucleotide
cgtgacggctaagccgcaacacaaaatgtatt

SEQ ID NO: 6205 - DNA, 32 bp, Artificial Sequence
  Synthetic polynucleotide
gaagaggtccacaatgagccagagatgtgtac

SEQ ID NO: 6206 - DNA, 32 bp, Artificial Sequence
  Synthetic polynucleotide
gccaaaattaagaccttcatggtatcacccta

SEQ ID NO: 6207 - DNA, 32 bp, Artificial Sequence
  Synthetic polynucleotide
atattgtacccgttccatcccggacatcgtgc

SEQ ID NO: 6208 - DNA, 32 bp, Artificial Sequence
  Synthetic polynucleotide
acatgaggatataactgtgtacctggctatac

SEQ ID NO: 6209 - DNA, 32 bp, Artificial Sequence
  Synthetic polynucleotide
ttttttttcgaccgtttccctaaatttttttt

SEQ ID NO: 6210 - DNA, 32 bp, Artificial Sequence
  Synthetic polynucleotide
aaatacgatgatgtccgagtacatctgtacta

SEQ ID NO: 6211 - DNA, 32 bp, Artificial Sequence
  Synthetic polynucleotide
gcgcccaccgggcatctataaaaatattgctc

SEQ ID NO: 6212 - DNA, 32 bp, Artificial Sequence
  Synthetic polynucleotide
aaactgagaacggtttcgaagtctcgatgcgg

SEQ ID NO: 6213 - DNA, 32 bp, Artificial Sequence
  Synthetic polynucleotide
accttcaatgaatctttgcagggtctccgcat

SEQ ID NO: 6214 - DNA, 32 bp, Artificial Sequence
  Synthetic polynucleotide
gcggatgctggttcaagcgagggtcgatagaa

SEQ ID NO: 6215 - DNA, 32 bp, Artificial Sequence
  Synthetic polynucleotide
ctcaataaccatgcgacactttaacggcgccg

SEQ ID NO: 6216 - DNA, 32 bp, Artificial Sequence
  Synthetic polynucleotide
agaactctagataggtacaatttctagatgcg

SEQ ID NO: 6217 - DNA, 32 bp, Artificial Sequence
  Synthetic polynucleotide
tttttttttggctggtacctatactttttttt

SEQ ID NO: 6218 - DNA, 32 bp, Artificial Sequence
  Synthetic polynucleotide
cactcccatcgcacgatatcttacaatgcgcc

SEQ ID NO: 6219 - DNA, 32 bp, Artificial Sequence
  Synthetic polynucleotide
tgctgtagagcgtgatgactctctctccattg

SEQ ID NO: 6220 - DNA, 32 bp, Artificial Sequence
  Synthetic polynucleotide
cccctcagcatcacgggatcatgtgcaacact

SEQ ID NO: 6221 - DNA, 32 bp, Artificial Sequence
  Synthetic polynucleotide
ggtatgctatcccctccagagatgctgtttaa

SEQ ID NO: 6222 - DNA, 32 bp, Artificial Sequence
  Synthetic polynucleotide
aaggagatttgtgctgcttactgcatagcaac

SEQ ID NO: 6223 - DNA, 32 bp, Artificial Sequence
  Synthetic polynucleotide
tttgcattttgttgcgagtgtggtcctgggaa

SEQ ID NO: 6224 - DNA, 32 bp, Artificial Sequence
  Synthetic polynucleotide
ttgctaggaacatggtgtttatttgtatatag

SEQ ID NO: 6225 - DNA, 32 bp, Artificial Sequence
  Synthetic polynucleotide
ttttttttttgtcttagactctactttttttt

SEQ ID NO: 6226 - DNA, 32 bp, Artificial Sequence
  Synthetic polynucleotide
taacatcgttgtgaaccagtatttacttcctg

SEQ ID NO: 6227 - DNA, 32 bp, Artificial Sequence
  Synthetic polynucleotide
gcaggcgtttaggtaaacttggacaaagtgag

SEQ ID NO: 6228 - DNA, 32 bp, Artificial Sequence
  Synthetic polynucleotide
gattcataccacggaaggagggtatcggtcaa

SEQ ID NO: 6229 - DNA, 32 bp, Artificial Sequence
  Synthetic polynucleotide
taacggcccgtgtctggcggcgaagagaacat

SEQ ID NO: 6230 - DNA, 32 bp, Artificial Sequence
  Synthetic polynucleotide
cgggtataattacgactcacgagggaaatact

SEQ ID NO: 6231 - DNA, 32 bp, Artificial Sequence
  Synthetic polynucleotide
gcctcgtggagcttgccgatgcttttgccaca

SEQ ID NO: 6232 - DNA, 32 bp, Artificial Sequence
  Synthetic polynucleotide
gtgctgcgcgccgtgttgagtctacatacatg

SEQ ID NO: 6233 - DNA, 32 bp, Artificial Sequence
  Synthetic polynucleotide
ttttttttggagcgtaggcggatatttttttt

SEQ ID NO: 6234 - DNA, 32 bp, Artificial Sequence
  Synthetic polynucleotide
tgcctaataccgtgggcgagtggatacactcg

SEQ ID NO: 6235 - DNA, 32 bp, Artificial Sequence
  Synthetic polynucleotide
tggtcgcgttatggagatgaatccactacacc

SEQ ID NO: 6236 - DNA, 32 bp, Artificial Sequence
  Synthetic polynucleotide
tcttatagtgccaatgatggattgagtgaccg

SEQ ID NO: 6237 - DNA, 32 bp, Artificial Sequence
  Synthetic polynucleotide
gttacgactggagtagagtcaatccctgctcc

SEQ ID NO: 6238 - DNA, 32 bp, Artificial Sequence
  Synthetic polynucleotide
tgcataccgcgaccgatgcgaggagataaggg

SEQ ID NO: 6239 - DNA, 32 bp, Artificial Sequence
  Synthetic polynucleotide
ggcccatatgagccaacagactactccccgga

SEQ ID NO: 6240 - DNA, 32 bp, Artificial Sequence
  Synthetic polynucleotide
ttttaacaggggatgatagcactattttggca

SEQ ID NO: 6241 - DNA, 32 bp, Artificial Sequence
  Synthetic polynucleotide
ttttttttcctgtgggcacttgactttttttt

SEQ ID NO: 6242 - DNA, 32 bp, Artificial Sequence
  Synthetic polynucleotide
cacaaaacccctatagttgtcgtttgcatggg

SEQ ID NO: 6243 - DNA, 32 bp, Artificial Sequence
  Synthetic polynucleotide
ctcctagcttgtcgagtagccagccgaacgca

SEQ ID NO: 6244 - DNA, 32 bp, Artificial Sequence
  Synthetic polynucleotide
gctctggaagctagctttcccatctcagggcg

SEQ ID NO: 6245 - DNA, 32 bp, Artificial Sequence
  Synthetic polynucleotide
gagatcctttttcttattgcgggggatcaccc

SEQ ID NO: 6246 - DNA, 32 bp, Artificial Sequence
  Synthetic polynucleotide
cgcgagacgaacctctcggtggacgacccacg

SEQ ID NO: 6247 - DNA, 32 bp, Artificial Sequence
  Synthetic polynucleotide
tatactagtagcgtctcacagcactcggcagc

SEQ ID NO: 6248 - DNA, 32 bp, Artificial Sequence
  Synthetic polynucleotide
gatgagtatcggagcgttaatcctcgatgtcg

SEQ ID NO: 6249 - DNA, 32 bp, Artificial Sequence
  Synthetic polynucleotide
tttttttttaggtgctatcgctgatttttttt

SEQ ID NO: 6250 - DNA, 32 bp, Artificial Sequence
  Synthetic polynucleotide
tatctttcctgcgcgcagaggtcggggacatg

SEQ ID NO: 6251 - DNA, 32 bp, Artificial Sequence
  Synthetic polynucleotide
ctaccgacacggacttccgaagttttcccatc

SEQ ID NO: 6252 - DNA, 32 bp, Artificial Sequence
  Synthetic polynucleotide
gttctacgaccatcgcgtcgggtctgttagct

SEQ ID NO: 6253 - DNA, 32 bp, Artificial Sequence
  Synthetic polynucleotide
tcaaaatgctctgcttctaatgtgttgaaaga

SEQ ID NO: 6254 - DNA, 32 bp, Artificial Sequence
  Synthetic polynucleotide
aactctaacctaatgacacctaccgccgtaaa

SEQ ID NO: 6255 - DNA, 32 bp, Artificial Sequence
  Synthetic polynucleotide
tattaatgaggcagtccactgtgatcacgtta

SEQ ID NO: 6256 - DNA, 32 bp, Artificial Sequence
  Synthetic polynucleotide
tgaacggttatgcggaccattcttgaacggct

SEQ ID NO: 6257 - DNA, 32 bp, Artificial Sequence
  Synthetic polynucleotide
ttttttttacattacggtcagaattttttttt

SEQ ID NO: 6258 - DNA, 32 bp, Artificial Sequence
  Synthetic polynucleotide
cgtgtcgaggattcgtgggagacatttcgggt

SEQ ID NO: 6259 - DNA, 32 bp, Artificial Sequence
  Synthetic polynucleotide
aaacccagtctatcacagacgcctccgcagag

SEQ ID NO: 6260 - DNA, 32 bp, Artificial Sequence
  Synthetic polynucleotide
tactgggagaaatatcgagatgtaatccgtca

SEQ ID NO: 6261 - DNA, 32 bp, Artificial Sequence
  Synthetic polynucleotide
acaaattatagataagcaggtggtctctgata

SEQ ID NO: 6262 - DNA, 32 bp, Artificial Sequence
  Synthetic polynucleotide
ttactgctggcaggcagctcttaaccatttca

SEQ ID NO: 6263 - DNA, 32 bp, Artificial Sequence
  Synthetic polynucleotide
tgtaccgaccctcacaagacgtttcctcacgc

SEQ ID NO: 6264 - DNA, 32 bp, Artificial Sequence
  Synthetic polynucleotide
gaagttcaaccctggccgcattacaggcggaa

SEQ ID NO: 6265 - DNA, 32 bp, Artificial Sequence
  Synthetic polynucleotide
tttttttttttacattctgcgtcatttttttt

SEQ ID NO: 6266 - DNA, 32 bp, Artificial Sequence
  Synthetic polynucleotide
gtaacagtgatgggagttcgcgtgttccagta

SEQ ID NO: 6267 - DNA, 32 bp, Artificial Sequence
  Synthetic polynucleotide
tatggtgacagcgcgggatgatactgtccgta

SEQ ID NO: 6268 - DNA, 32 bp, Artificial Sequence
  Synthetic polynucleotide
attacctttggtggatgtcggccccacctagg

SEQ ID NO: 6269 - DNA, 32 bp, Artificial Sequence
  Synthetic polynucleotide
gcctcagtagtttcaccttggcttttaatggg

SEQ ID NO: 6270 - DNA, 32 bp, Artificial Sequence
  Synthetic polynucleotide
gaacataagttaactcaactgccggacgcccc

SEQ ID NO: 6271 - DNA, 32 bp, Artificial Sequence
  Synthetic polynucleotide
aataggctgcaggttatttcggaggaaactac

SEQ ID NO: 6272 - DNA, 32 bp, Artificial Sequence
  Synthetic polynucleotide
gatctttcccttgatgtataccaagggatttc

SEQ ID NO: 6273 - DNA, 32 bp, Artificial Sequence
  Synthetic polynucleotide
ttttttttaacgttatctggtacttttttttt

SEQ ID NO: 6274 - DNA, 32 bp, Artificial Sequence
  Synthetic polynucleotide
tggccctttgggatctgtgccagtagcttaat

SEQ ID NO: 6275 - DNA, 32 bp, Artificial Sequence
  Synthetic polynucleotide
acggaaacaacactccttccacgattacctat

SEQ ID NO: 6276 - DNA, 32 bp, Artificial Sequence
  Synthetic polynucleotide
aagagcacaagaacgctagtaagggtagatcc

SEQ ID NO: 6277 - DNA, 32 bp, Artificial Sequence
  Synthetic polynucleotide
gccgctgacaccgctcgtgtccttaatcgccg

SEQ ID NO: 6278 - DNA, 32 bp, Artificial Sequence
  Synthetic polynucleotide
ggagggttaacgggttcacttccaatataaca

SEQ ID NO: 6279 - DNA, 32 bp, Artificial Sequence
  Synthetic polynucleotide
ttcattacaaaacgtactcacacctgacactg

SEQ ID NO: 6280 - DNA, 32 bp, Artificial Sequence
  Synthetic polynucleotide
aatgagctatctatccagaagattgactattg

SEQ ID NO: 6281 - DNA, 32 bp, Artificial Sequence
  Synthetic polynucleotide
ttttttttggaccgagaccggatatttttttt

SEQ ID NO: 6282 - DNA, 32 bp, Artificial Sequence
  Synthetic polynucleotide
cattccacggctagaattgcggtattcgccct

SEQ ID NO: 6283 - DNA, 32 bp, Artificial Sequence
  Synthetic polynucleotide
ggagtatgttcaacaactcgaattaggcgagt

SEQ ID NO: 6284 - DNA, 32 bp, Artificial Sequence
  Synthetic polynucleotide
gcatgccggataggacttatgtcgaatgagac

SEQ ID NO: 6285 - DNA, 32 bp, Artificial Sequence
  Synthetic polynucleotide
tgtaaagggtcaggagcctaacataggtctta

SEQ ID NO: 6286 - DNA, 32 bp, Artificial Sequence
  Synthetic polynucleotide
caaatatctttcggagagggccaaggcctcag

SEQ ID NO: 6287 - DNA, 32 bp, Artificial Sequence
  Synthetic polynucleotide
acacggtgtataacccagtctggcgatgtaga

SEQ ID NO: 6288 - DNA, 32 bp, Artificial Sequence
  Synthetic polynucleotide
tcggtcacgcgaagctaatctcgtcgtcgatc

SEQ ID NO: 6289 - DNA, 32 bp, Artificial Sequence
  Synthetic polynucleotide
ttttttttactagcgcagggattgtttttttt

SEQ ID NO: 6290 - DNA, 32 bp, Artificial Sequence
  Synthetic polynucleotide
gcttaacattaccagcaaagtctaagaaggga

SEQ ID NO: 6291 - DNA, 32 bp, Artificial Sequence
  Synthetic polynucleotide
tcttggtgttatttactatgattcggacgagc

SEQ ID NO: 6292 - DNA, 32 bp, Artificial Sequence
  Synthetic polynucleotide
cccacgttacattggttatcgtgcctataacg

SEQ ID NO: 6293 - DNA, 32 bp, Artificial Sequence
  Synthetic polynucleotide
tcacctaaaccagttttatcattggaagcgag

SEQ ID NO: 6294 - DNA, 32 bp, Artificial Sequence
  Synthetic polynucleotide
cagccttctgagattacggggagcagatctag

SEQ ID NO: 6295 - DNA, 32 bp, Artificial Sequence
  Synthetic polynucleotide
cccccctacacaaagagcatacgccctggttt

SEQ ID NO: 6296 - DNA, 32 bp, Artificial Sequence
  Synthetic polynucleotide
tcggtgactggacaaatcaccgcgagtgtgta

SEQ ID NO: 6297 - DNA, 32 bp, Artificial Sequence
  Synthetic polynucleotide
ttttttttagaaaacccaaatccctttttttt

SEQ ID NO: 6298 - DNA, 32 bp, Artificial Sequence
  Synthetic polynucleotide
catatccgtctgagtcaatcttggtctcgata

SEQ ID NO: 6299 - DNA, 32 bp, Artificial Sequence
  Synthetic polynucleotide
aaggaacggtctacagtacaggtgcgccgatt

SEQ ID NO: 6300 - DNA, 32 bp, Artificial Sequence
  Synthetic polynucleotide
aaacgcgtttggcctttctataacaaactaaa

SEQ ID NO: 6301 - DNA, 32 bp, Artificial Sequence
  Synthetic polynucleotide
gggtacaacggcattaaagccactcctttcac

SEQ ID NO: 6302 - DNA, 32 bp, Artificial Sequence
  Synthetic polynucleotide
ttcgtgtgaaccgcgtgccaaggacaccaggt

SEQ ID NO: 6303 - DNA, 32 bp, Artificial Sequence
  Synthetic polynucleotide
agcgatggcccccgaatgctcgcgtatcagga

SEQ ID NO: 6304 - DNA, 32 bp, Artificial Sequence
  Synthetic polynucleotide
ttaagagccctttatcatgcataatttcatag

SEQ ID NO: 6305 - DNA, 32 bp, Artificial Sequence
  Synthetic polynucleotide
tttttttttagtgttgaatacccatttttttt

SEQ ID NO: 6306 - DNA, 32 bp, Artificial Sequence
  Synthetic polynucleotide
aatccgggcggggcatccaacaggaaacttct

SEQ ID NO: 6307 - DNA, 32 bp, Artificial Sequence
  Synthetic polynucleotide
cctatcaccgacctgaagcccagatgtaccgc

SEQ ID NO: 6308 - DNA, 32 bp, Artificial Sequence
  Synthetic polynucleotide
ttggcaaagctgagagtgtttgatcccctgcg

SEQ ID NO: 6309 - DNA, 32 bp, Artificial Sequence
  Synthetic polynucleotide
acgtccgagggtaaacatctgcttagtagttt

SEQ ID NO: 6310 - DNA, 32 bp, Artificial Sequence
  Synthetic polynucleotide
tgccacaccgcgtgtaatggattaatcactga

SEQ ID NO: 6311 - DNA, 32 bp, Artificial Sequence
  Synthetic polynucleotide
tactcctgctaacagggttaaaaagaggcagc

SEQ ID NO: 6312 - DNA, 32 bp, Artificial Sequence
  Synthetic polynucleotide
tagtgacgggtcgggttaggtcgggcctacgt

SEQ ID NO: 6313 - DNA, 32 bp, Artificial Sequence
  Synthetic polynucleotide
ttttttttcgggcgactacaggcatttttttt

SEQ ID NO: 6314 - DNA, 32 bp, Artificial Sequence
  Synthetic polynucleotide
ttgcagttacagggagtcaggatcattcaaga

SEQ ID NO: 6315 - DNA, 32 bp, Artificial Sequence
  Synthetic polynucleotide
ggcgtgtagtgctctgacttgattacggctag

SEQ ID NO: 6316 - DNA, 32 bp, Artificial Sequence
  Synthetic polynucleotide
ctgcccatgtcaagaccgttgcacattttgga

SEQ ID NO: 6317 - DNA, 32 bp, Artificial Sequence
  Synthetic polynucleotide
cagttgcccttaaccgacgttgttaggcgagg

SEQ ID NO: 6318 - DNA, 32 bp, Artificial Sequence
  Synthetic polynucleotide
gctctggaagttacaagtgtaagaattgtacc

SEQ ID NO: 6319 - DNA, 32 bp, Artificial Sequence
  Synthetic polynucleotide
actccgctgtgttaacacacagttacgaatac

SEQ ID NO: 6320 - DNA, 32 bp, Artificial Sequence
  Synthetic polynucleotide
agttgagtaacaaggaatattacagtcactgc

SEQ ID NO: 6321 - DNA, 32 bp, Artificial Sequence
  Synthetic polynucleotide
tttttttttttcaccgtttaagtttttttttt

SEQ ID NO: 6322 - DNA, 32 bp, Artificial Sequence
  Synthetic polynucleotide
tgtgtggaccgaaaatacttaaccgaggcctt

SEQ ID NO: 6323 - DNA, 32 bp, Artificial Sequence
  Synthetic polynucleotide
tactctaatctttgctcgccgaccacatatca

SEQ ID NO: 6324 - DNA, 32 bp, Artificial Sequence
  Synthetic polynucleotide
ctaacgcgatccgcttagtatggatctttgca

SEQ ID NO: 6325 - DNA, 32 bp, Artificial Sequence
  Synthetic polynucleotide
caagcggggttaacatttccatgtaacccgtg

SEQ ID NO: 6326 - DNA, 32 bp, Artificial Sequence
  Synthetic polynucleotide
tcgctttatccttactcccaataagagccgat

SEQ ID NO: 6327 - DNA, 32 bp, Artificial Sequence
  Synthetic polynucleotide
cagtcgccgtcgttacagcggtcgccgtcatg

SEQ ID NO: 6328 - DNA, 32 bp, Artificial Sequence
  Synthetic polynucleotide
agtgcgcccctgtctaagtgtaagtgccatat

SEQ ID NO: 6329 - DNA, 32 bp, Artificial Sequence
  Synthetic polynucleotide
ttttttttcagaattacgagttgatttttttt

SEQ ID NO: 6330 - DNA, 48 bp, Artificial Sequence
  Synthetic polynucleotide
ttaatttagatgtcaaccctcacattccaggcaaagaagtccgacatc

SEQ ID NO: 6331 - DNA, 32 bp, Artificial Sequence
  Synthetic polynucleotide
agtccttcgcaggtggttggaatgtgtattct

SEQ ID NO: 6332 - DNA, 48 bp, Artificial Sequence
  Synthetic polynucleotide
gtctttagttggtgcatccaataaggtcctctcacggctttagagacc

SEQ ID NO: 6333 - DNA, 32 bp, Artificial Sequence
  Synthetic polynucleotide
cgttctagtcaacccccctagtcactaactat

SEQ ID NO: 6334 - DNA, 48 bp, Artificial Sequence
  Synthetic polynucleotide
ggtcacacggtggcaaagtatgaattgcggcaaagagtgacccgctga

SEQ ID NO: 6335 - DNA, 32 bp, Artificial Sequence
  Synthetic polynucleotide
attactttagcgctattatcggttgtaccgca

SEQ ID NO: 6336 - DNA, 48 bp, Artificial Sequence
  Synthetic polynucleotide
gtttagtgcaacccatggccgaaacatgtaggaagtgtgatttttttt

SEQ ID NO: 6337 - DNA, 32 bp, Artificial Sequence
  Synthetic polynucleotide
ttttttttttgctataagttggtctttttttt

SEQ ID NO: 6338 - DNA, 48 bp, Artificial Sequence
  Synthetic polynucleotide
cctgcctagtaatctccccttcccgtggtccagtgcggcccgctgtaa

SEQ ID NO: 6339 - DNA, 32 bp, Artificial Sequence
  Synthetic polynucleotide
cgggcccaagcagtacaacaaaatacagcctt

SEQ ID NO: 6340 - DNA, 48 bp, Artificial Sequence
  Synthetic polynucleotide
ggaaggtcacaaacccattcatggggtcggatgtagacattgattgag

SEQ ID NO: 6341 - DNA, 32 bp, Artificial Sequence
  Synthetic polynucleotide
aactgcgcaaatgtgaacgctcgatcattaag

SEQ ID NO: 6342 - DNA, 48 bp, Artificial Sequence
  Synthetic polynucleotide
atccgaagatcaaggattgtcgggcattacgacgattgctcgtacccc

SEQ ID NO: 6343 - DNA, 32 bp, Artificial Sequence
  Synthetic polynucleotide
atggttatgccagagagtgtaatgctctcctt

SEQ ID NO: 6344 - DNA, 48 bp, Artificial Sequence
  Synthetic polynucleotide
gactttgttcaccaggacaccgatgctggggatcatttgctttttttt

SEQ ID NO: 6345 - DNA, 32 bp, Artificial Sequence
  Synthetic polynucleotide
ttttttttccctcccacggcaatatttttttt

SEQ ID NO: 6346 - DNA, 16 bp, Artificial Sequence
  Synthetic polynucleotide
cacagcgcatcccgtt

SEQ ID NO: 6347 - DNA, 48 bp, Artificial Sequence
  Synthetic polynucleotide
tccccccactacatttcggcgacgaagcctgttgttgagggtgtttcc

SEQ ID NO: 6348 - DNA, 48 bp, Artificial Sequence
  Synthetic polynucleotide
atattgaactggttttcacccgcctttcataaccatatcatcctaccc

SEQ ID NO: 6349 - DNA, 48 bp, Artificial Sequence
  Synthetic polynucleotide
ccctggagacacactccaatatacaaccatttagtaaacaagtaccca

SEQ ID NO: 6350 - DNA, 32 bp, Artificial Sequence
  Synthetic polynucleotide
ttttttttgacgaaggcttatccttttttttt

SEQ ID NO: 6351 - DNA, 16 bp, Artificial Sequence
  Synthetic polynucleotide
catggtcccctacgcc

SEQ ID NO: 6352 - DNA, 48 bp, Artificial Sequence
  Synthetic polynucleotide
aaacatactgacagaacgaggcgtactgcgagttgcgctgtcccgtct

SEQ ID NO: 6353 - DNA, 48 bp, Artificial Sequence
  Synthetic polynucleotide
tgaaagaatttcgtaaggagagcaagtatccacagccctctcttcacc

SEQ ID NO: 6354 - DNA, 48 bp, Artificial Sequence
  Synthetic polynucleotide
ctttatttacaactgtgggctcacgcccccgtatcccttgctcccgaa

SEQ ID NO: 6355 - DNA, 32 bp, Artificial Sequence
  Synthetic polynucleotide
ttttttttacgggtacttgtgatctttttttt

SEQ ID NO: 6356 - DNA, 48 bp, Artificial Sequence; identical to SEQ ID NO: 82
  Synthetic polynucleotide

SEQ ID NO: 6357 - DNA, 32 bp, Artificial Sequence
  Synthetic polynucleotide
gctcgggtagtctcaagaagatagagagcata

SEQ ID NO: 6358 - DNA, 32 bp, Artificial Sequence; identical to SEQ ID NO: 83
  Synthetic polynucleotide

SEQ ID NO: 6359 - DNA, 32 bp, Artificial Sequence; identical to SEQ ID NO: 888
  Synthetic polynucleotide

SEQ ID NO: 6360 - DNA, 32 bp, Artificial Sequence
  Synthetic polynucleotide
gaacggtgacacacttgtgttcattcagagta

SEQ ID NO: 6361 - DNA, 32 bp, Artificial Sequence
  Synthetic polynucleotide
actcagtgatcgagtattcatgtcgccttttc

SEQ ID NO: 6362 - DNA, 32 bp, Artificial Sequence; identical to SEQ ID NO: 1898
  Synthetic polynucleotide

SEQ ID NO: 6363 - DNA, 32 bp, Artificial Sequence; identical to SEQ ID NO: 892
  Synthetic polynucleotide

SEQ ID NO: 6364 - DNA, 32 bp, Artificial Sequence
  Synthetic polynucleotide
ccgcctgtaacgcttaatcagcccgggctttt

SEQ ID NO: 6365 - DNA, 32 bp, Artificial Sequence
  Synthetic polynucleotide
gtttctgaaccggaacccgggctaatgaagcc

SEQ ID NO: 6366 - DNA, 32 bp, Artificial Sequence
  Synthetic polynucleotide
ccagccacttagctgtgtcagtgtgatcgcga

SEQ ID NO: 6367 - DNA, 32 bp, Artificial Sequence; identical to SEQ ID NO: 13
  Synthetic polynucleotide

SEQ ID NO: 6368 - DNA, 32 bp, Artificial Sequence; identical to SEQ ID NO: 104
  Synthetic polynucleotide

SEQ ID NO: 6369 - DNA, 32 bp, Artificial Sequence
  Synthetic polynucleotide
tgacctggtataatggcggagctacctgacct

SEQ ID NO: 6370 - DNA, 32 bp, Artificial Sequence
  Synthetic polynucleotide
ggatatggagctggaacggctctgatttctag

SEQ ID NO: 6371 - DNA, 48 bp, Artificial Sequence
  Synthetic polynucleotide
caatcatacgtcccacggaaggattcatcccctttaagaatgatcgca

SEQ ID NO: 6372 - DNA, 32 bp, Artificial Sequence; identical to SEQ ID NO: 21
  Synthetic polynucleotide

SEQ ID NO: 6373 - DNA, 16 bp, Artificial Sequence
  Synthetic polynucleotide
gcgtaaagatctcgca

SEQ ID NO: 6374 - DNA, 48 bp, Artificial Sequence; identical to SEQ ID NO: 1910
  Synthetic polynucleotide

SEQ ID NO: 6375 - DNA, 32 bp, Artificial Sequence
  Synthetic polynucleotide
ttctggtgccaaaactgccgactcgttcaagc

SEQ ID NO: 6376 - DNA, 32 bp, Artificial Sequence; identical to SEQ ID NO: 3319
  Synthetic polynucleotide

SEQ ID NO: 6377 - DNA, 32 bp, Artificial Sequence; identical to SEQ ID NO: 28
  Synthetic polynucleotide

SEQ ID NO: 6378 - DNA, 32 bp, Artificial Sequence; identical to SEQ ID NO: 4430
  Synthetic polynucleotide

SEQ ID NO: 6379 - DNA, 32 bp, Artificial Sequence; identical to SEQ ID NO: 4534
  Synthetic polynucleotide

SEQ ID NO: 6380 - DNA, 32 bp, Artificial Sequence; identical to SEQ ID NO: 32
  Synthetic polynucleotide

SEQ ID NO: 6381 - DNA, 32 bp, Artificial Sequence; identical to SEQ ID NO: 31
  Synthetic polynucleotide

SEQ ID NO: 6382 - DNA, 32 bp, Artificial Sequence; identical to SEQ ID NO: 33
  Synthetic polynucleotide

SEQ ID NO: 6383 - DNA, 32 bp, Artificial Sequence; identical to SEQ ID NO: 35
  Synthetic polynucleotide

SEQ ID NO: 6384 - DNA, 32 bp, Artificial Sequence; identical to SEQ ID NO: 34
  Synthetic polynucleotide

SEQ ID NO: 6385 - DNA, 32 bp, Artificial Sequence; identical to SEQ ID NO: 36
  Synthetic polynucleotide

SEQ ID NO: 6386 - DNA, 32 bp, Artificial Sequence; identical to SEQ ID NO: 38
  Synthetic polynucleotide

SEQ ID NO: 6387 - DNA, 32 bp, Artificial Sequence; identical to SEQ ID NO: 37
  Synthetic polynucleotide

SEQ ID NO: 6388 - DNA, 32 bp, Artificial Sequence; identical to SEQ ID NO: 39
  Synthetic polynucleotide

SEQ ID NO: 6389 - DNA, 48 bp, Artificial Sequence; identical to SEQ ID NO: 149
  Synthetic polynucleotide

SEQ ID NO: 6390 - DNA, 16 bp, Artificial Sequence
  Synthetic polynucleotide
tatgcgcccgatatcc

SEQ ID NO: 6391 - DNA, 48 bp, Artificial Sequence
  Synthetic polynucleotide
gaacagcttagagcagtcaagttcggatacgctacctatggacgggga

SEQ ID NO: 6392 - DNA, 32 bp, Artificial Sequence; identical to SEQ ID NO: 918
  Synthetic polynucleotide

SEQ ID NO: 6393 - DNA, 32 bp, Artificial Sequence
  Synthetic polynucleotide
tatgcgacaccatgatccggatgagttatgaa

SEQ ID NO: 6394 - DNA, 32 bp, Artificial Sequence
  Synthetic polynucleotide
agcatagcaccctgcgaagatagggtcacagc

SEQ ID NO: 6395 - DNA, 32 bp, Artificial Sequence
  Synthetic polynucleotide
gaaataacgaccagaaagcacgaggattatca

SEQ ID NO: 6396 - DNA, 32 bp, Artificial Sequence
  Synthetic polynucleotide
agtaatacctctaccttgttggacgtaagcgt

SEQ ID NO: 6397 - DNA, 32 bp, Artificial Sequence
  Synthetic polynucleotide
cgtgtacctcgaaataatcgttagtttctcga

SEQ ID NO: 6398 - DNA, 32 bp, Artificial Sequence
  Synthetic polynucleotide
ttaacctatgccttggtaactgattttctcct

SEQ ID NO: 6399 - DNA, 32 bp, Artificial Sequence
  Synthetic polynucleotide
ctgttccgaaacaggcagcggtagcctcccac

SEQ ID NO: 6400 - DNA, 32 bp, Artificial Sequence; identical to SEQ ID NO: 54
  Synthetic polynucleotide

SEQ ID NO: 6401 - DNA, 32 bp, Artificial Sequence
  Synthetic polynucleotide
ggccacctggctcggggagtgccccctcggca

SEQ ID NO: 6402 - DNA, 32 bp, Artificial Sequence; identical to SEQ ID NO: 377
  Synthetic polynucleotide

SEQ ID NO: 6403 - DNA, 32 bp, Artificial Sequence
  Synthetic polynucleotide
gccgcctcggttatactcgtcaagcctgcttt

SEQ ID NO: 6404 - DNA, 32 bp, Artificial Sequence
  Synthetic polynucleotide
gtcgtacttaaagcaaacgtgggagtgcccga

SEQ ID NO: 6405 - DNA, 32 bp, Artificial Sequence; identical to SEQ ID NO: 252
  Synthetic polynucleotide

SEQ ID NO: 6406 - DNA, 48 bp, Artificial Sequence
  Synthetic polynucleotide
gcgtctgaggtatggtttacccactatgttgtctcaagtgctaacagt

SEQ ID NO: 6407 - DNA, 32 bp, Artificial Sequence; identical to SEQ ID NO: 63
  Synthetic polynucleotide

SEQ ID NO: 6408 - DNA, 16 bp, Artificial Sequence
  Synthetic polynucleotide
tctcaccggtggccgt

SEQ ID NO: 6409 - DNA, 48 bp, Artificial Sequence; identical to SEQ ID NO: 1941
  Synthetic polynucleotide

SEQ ID NO: 6410 - DNA, 32 bp, Artificial Sequence; identical to SEQ ID NO: 1940
  Synthetic polynucleotide

SEQ ID NO: 6411 - DNA, 32 bp, Artificial Sequence; identical to SEQ ID NO: 67
  Synthetic polynucleotide

SEQ ID NO: 6412 - DNA, 32 bp, Artificial Sequence; identical to SEQ ID NO: 936
  Synthetic polynucleotide

SEQ ID NO: 6413 - DNA, 32 bp, Artificial Sequence; identical to SEQ ID NO: 1943
  Synthetic polynucleotide

SEQ ID NO: 6414 - DNA, 32 bp, Artificial Sequence; identical to SEQ ID NO: 392
  Synthetic polynucleotide

SEQ ID NO: 6415 - DNA, 32 bp, Artificial Sequence; identical to SEQ ID NO: 74
  Synthetic polynucleotide

SEQ ID NO: 6416 - DNA, 32 bp, Artificial Sequence; identical to SEQ ID NO: 73
  Synthetic polynucleotide

SEQ ID NO: 6417 - DNA, 32 bp, Artificial Sequence; identical to SEQ ID NO: 75
  Synthetic polynucleotide

SEQ ID NO: 6418 - DNA, 32 bp, Artificial Sequence; identical to SEQ ID NO: 77
  Synthetic polynucleotide

SEQ ID NO: 6419 - DNA, 32 bp, Artificial Sequence; identical to SEQ ID NO: 76
  Synthetic polynucleotide

SEQ ID NO: 6420 - DNA, 32 bp, Artificial Sequence; identical to SEQ ID NO: 78
  Synthetic polynucleotide

SEQ ID NO: 6421 - DNA, 32 bp, Artificial Sequence; identical to SEQ ID NO: 158
  Synthetic polynucleotide

SEQ ID NO: 6422 - DNA, 32 bp, Artificial Sequence; identical to SEQ ID NO: 157
  Synthetic polynucleotide

SEQ ID NO: 6423 - DNA, 32 bp, Artificial Sequence; identical to SEQ ID NO: 4377
  Synthetic polynucleotide

SEQ ID NO: 6424 - DNA, 48 bp, Artificial Sequence; identical to SEQ ID NO: 946
  Synthetic polynucleotide

SEQ ID NO: 6425 - DNA, 16 bp, Artificial Sequence
  Synthetic polynucleotide
gtaccgccagttcttg

SEQ ID NO: 6426 - DNA, 48 bp, Artificial Sequence; identical to SEQ ID NO: 403
  Synthetic polynucleotide

SEQ ID NO: 6427 - DNA, 32 bp, Artificial Sequence
  Synthetic polynucleotide
gacaaaaacagatttgtaccggggtgaacagc

SEQ ID NO: 6428 - DNA, 32 bp, Artificial Sequence; identical to SEQ ID NO: 405
  Synthetic polynucleotide

SEQ ID NO: 6429 - DNA, 32 bp, Artificial Sequence
  Synthetic polynucleotide
acgtgcggcttctcctgtatcgccttgtgtat

SEQ ID NO: 6430 - DNA, 32 bp, Artificial Sequence; identical to SEQ ID NO: 1960
  Synthetic polynucleotide

SEQ ID NO: 6431 - DNA, 32 bp, Artificial Sequence
  Synthetic polynucleotide
tatactcttgcgggggggtcgagcgctccact

SEQ ID NO: 6432 - DNA, 32 bp, Artificial Sequence
  Synthetic polynucleotide
cggcaatctgaatatcgctacctccgatacgc

SEQ ID NO: 6433 - DNA, 32 bp, Artificial Sequence
  Synthetic polynucleotide
tcagccaaacagtgggacatctcggaaaggtg

SEQ ID NO: 6434 - DNA, 32 bp, Artificial Sequence
  Synthetic polynucleotide
gaaccagaaccatttaagagtaggggcagtgc

SEQ ID NO: 6435 - DNA, 32 bp, Artificial Sequence
  Synthetic polynucleotide
tcccaagtgcaagtaaaaaaggaattatgaga

SEQ ID NO: 6436 - DNA, 32 bp, Artificial Sequence
  Synthetic polynucleotide
cgtaggctagagcggtgatatccacggtacat

SEQ ID NO: 6437 - DNA, 32 bp, Artificial Sequence
  Synthetic polynucleotide
tcatgtgggatcctaaagtttctggtagacct

SEQ ID NO: 6438 - DNA, 32 bp, Artificial Sequence; identical to SEQ ID NO: 4711
  Synthetic polynucleotide

SEQ ID NO: 6439 - DNA, 32 bp, Artificial Sequence
  Synthetic polynucleotide
cgttgcgaattttcgcgcgattcgcatgtagc

SEQ ID NO: 6440 - DNA, 32 bp, Artificial Sequence
  Synthetic polynucleotide
aagcaagagaaacctaacttggggactaagat

SEQ ID NO: 6441 - DNA, 48 bp, Artificial Sequence; identical to SEQ ID NO: 961
  Synthetic polynucleotide

SEQ ID NO: 6442 - DNA, 32 bp, Artificial Sequence; identical to SEQ ID NO: 419
  Synthetic polynucleotide

SEQ ID NO: 6443 - DNA, 16 bp, Artificial Sequence
  Synthetic polynucleotide
cagcttgacgcaagac

SEQ ID NO: 6444 - DNA, 48 bp, Artificial Sequence
  Synthetic polynucleotide
aacctaccccctaagcagcgtagtaagggttacaagttcctgcggcgg

SEQ ID NO: 6445 - DNA, 32 bp, Artificial Sequence
  Synthetic polynucleotide
gctaatcactgggcagggtcctaggttgcaga

SEQ ID NO: 6446 - DNA, 32 bp, Artificial Sequence
  Synthetic polynucleotide
ctgtacgaatgagtccggccttgacatgacat

SEQ ID NO: 6447 - DNA, 32 bp, Artificial Sequence; identical to SEQ ID NO: 1976
  Synthetic polynucleotide

SEQ ID NO: 6448 - DNA, 32 bp, Artificial Sequence
  Synthetic polynucleotide
tctcccacccgtccaacaccagcaggatgtcg

SEQ ID NO: 6449 - DNA, 32 bp, Artificial Sequence; identical to SEQ ID NO: 968
  Synthetic polynucleotide

SEQ ID NO: 6450 - DNA, 32 bp, Artificial Sequence
  Synthetic polynucleotide
aaccccgtaaatcgtaagagtcgttatgcccc

SEQ ID NO: 6451 - DNA, 32 bp, Artificial Sequence
  Synthetic polynucleotide
tgcgtacggcttttatatagcgtagaccggac

SEQ ID NO: 6452 - DNA, 32 bp, Artificial Sequence
  Synthetic polynucleotide
ccggttctgctagagtgggactggatcagatg

SEQ ID NO: 6453 - DNA, 32 bp, Artificial Sequence; identical to SEQ ID NO: 429
  Synthetic polynucleotide

SEQ ID NO: 6454 - DNA, 32 bp, Artificial Sequence; identical to SEQ ID NO: 428
  Synthetic polynucleotide

SEQ ID NO: 6455 - DNA, 32 bp, Artificial Sequence; identical to SEQ ID NO: 431
  Synthetic polynucleotide

SEQ ID NO: 6456 - DNA, 32 bp, Artificial Sequence; identical to SEQ ID NO: 432
  Synthetic polynucleotide

SEQ ID NO: 6457 - DNA, 32 bp, Artificial Sequence; identical to SEQ ID NO: 430
  Synthetic polynucleotide

SEQ ID NO: 6458 - DNA, 32 bp, Artificial Sequence; identical to SEQ ID NO: 1984
  Synthetic polynucleotide

SEQ ID NO: 6459 - DNA, 48 bp, Artificial Sequence; identical to SEQ ID NO: 434
  Synthetic polynucleotide

SEQ ID NO: 6460 - DNA, 16 bp, Artificial Sequence
  Synthetic polynucleotide
cggactgcattctgga

SEQ ID NO: 6461 - DNA, 48 bp, Artificial Sequence
  Synthetic polynucleotide
agttgaaaattatctcgataagcagaaggacctgtataactggcaaga

SEQ ID NO: 6462 - DNA, 32 bp, Artificial Sequence
  Synthetic polynucleotide
gtattaatgccgcgccaacggtttcccggacc

SEQ ID NO: 6463 - DNA, 32 bp, Artificial Sequence
  Synthetic polynucleotide
gacaaggccgcttcagaaaggatagccggacc

SEQ ID NO: 6464 - DNA, 32 bp, Artificial Sequence
  Synthetic polynucleotide
tagtgtctatcaagtctattctatgaaaccat

SEQ ID NO: 6465 - DNA, 32 bp, Artificial Sequence
  Synthetic polynucleotide
cgagaagcgtatagatgttccgcgcgaatagc

SEQ ID NO: 6466 - DNA, 32 bp, Artificial Sequence
  Synthetic polynucleotide
tctcgggtcgagcgggtcactgttgtgaccta

SEQ ID NO: 6467 - DNA, 32 bp, Artificial Sequence
  Synthetic polynucleotide
tcacaggcgaactacgtatgaattggtttaaa

SEQ ID NO: 6468 - DNA, 32 bp, Artificial Sequence; identical to SEQ ID NO: 5487
  Synthetic polynucleotide

SEQ ID NO: 6469 - DNA, 32 bp, Artificial Sequence
  Synthetic polynucleotide
cgctcctcgggaattaatacgacaggtggcaa

SEQ ID NO: 6470 - DNA, 32 bp, Artificial Sequence
  Synthetic polynucleotide
cactgtgaatttccacaccgaggattcgcagg

SEQ ID NO: 6471 - DNA, 32 bp, Artificial Sequence
  Synthetic polynucleotide
gattctccatggcagcgcttcggtacaggtct

SEQ ID NO: 6472 - DNA, 32 bp, Artificial Sequence; identical to SEQ ID NO: 443
  Synthetic polynucleotide

SEQ ID NO: 6473 - DNA, 32 bp, Artificial Sequence; identical to SEQ ID NO: 1998
  Synthetic polynucleotide

SEQ ID NO: 6474 - DNA, 32 bp, Artificial Sequence
  Synthetic polynucleotide
tcgtcgtgtaatgctgttccggggtaaatcaa

SEQ ID NO: 6475 - DNA, 32 bp, Artificial Sequence
  Synthetic polynucleotide
gttcggctcccttgtggactcgggatacccgg

SEQ ID NO: 6476 - DNA, 48 bp, Artificial Sequence
  Synthetic polynucleotide
gctttataaattcccgacgctctgttccaaactttagagcccggccgt

SEQ ID NO: 6477 - DNA, 32 bp, Artificial Sequence
  Synthetic polynucleotide
aatctcggattccttaaaaaccaggcgcaatc

SEQ ID NO: 6478 - DNA, 16 bp, Artificial Sequence
  Synthetic polynucleotide
tcatggcataaacgaa

SEQ ID NO: 6479 - DNA, 48 bp, Artificial Sequence
  Synthetic polynucleotide
ctactggcgttttcatatatcagagagcacagtaattcggagcccggc

SEQ ID NO: 6480 - DNA, 32 bp, Artificial Sequence
  Synthetic polynucleotide
acccaatcatacgagcgtggagggaagttatt

SEQ ID NO: 6481 - DNA, 32 bp, Artificial Sequence; identical to SEQ ID NO: 2005
  Synthetic polynucleotide

SEQ ID NO: 6482 - DNA, 32 bp, Artificial Sequence; identical to SEQ ID NO: 2007
  Synthetic polynucleotide

SEQ ID NO: 6483 - DNA, 32 bp, Artificial Sequence; identical to SEQ ID NO: 2006
  Synthetic polynucleotide

SEQ ID NO: 6484 - DNA, 32 bp, Artificial Sequence; identical to SEQ ID NO: 2008
  Synthetic polynucleotide

SEQ ID NO: 6485 - DNA, 32 bp, Artificial Sequence; identical to SEQ ID NO: 2010
  Synthetic polynucleotide

SEQ ID NO: 6486 - DNA, 32 bp, Artificial Sequence; identical to SEQ ID NO: 2009
  Synthetic polynucleotide

SEQ ID NO: 6487 - DNA, 32 bp, Artificial Sequence; identical to SEQ ID NO: 2011
  Synthetic polynucleotide

SEQ ID NO: 6488 - DNA, 32 bp, Artificial Sequence; identical to SEQ ID NO: 2013
  Synthetic polynucleotide

SEQ ID NO: 6489 - DNA, 32 bp, Artificial Sequence; identical to SEQ ID NO: 2012
  Synthetic polynucleotide

SEQ ID NO: 6490 - DNA, 32 bp, Artificial Sequence; identical to SEQ ID NO: 3786
  Synthetic polynucleotide

SEQ ID NO: 6491 - DNA, 32 bp, Artificial Sequence; identical to SEQ ID NO: 3846
  Synthetic polynucleotide

SEQ ID NO: 6492 - DNA, 32 bp, Artificial Sequence; identical to SEQ ID NO: 3813
  Synthetic polynucleotide

SEQ ID NO: 6493 - DNA, 32 bp, Artificial Sequence; identical to SEQ ID NO: 3876
  Synthetic polynucleotide

SEQ ID NO: 6494 - DNA, 48 bp, Artificial Sequence
  Synthetic polynucleotide
gctcggtagaccatgtctccagtattgccattttctaattaatacttt

SEQ ID NO: 6495 - DNA, 16 bp, Artificial Sequence
  Synthetic polynucleotide
gagacactcatttact

SEQ ID NO: 6496 - DNA, 48 bp, Artificial Sequence; identical to SEQ ID NO: 2019
  Synthetic polynucleotide

SEQ ID NO: 6497 - DNA, 32 bp, Artificial Sequence
  Synthetic polynucleotide
ctttgtggtccactatatataggtctgacacc

SEQ ID NO: 6498 - DNA, 32 bp, Artificial Sequence; identical to SEQ ID NO: 2020
  Synthetic polynucleotide

SEQ ID NO: 6499 - DNA, 32 bp, Artificial Sequence
  Synthetic polynucleotide
cagctcccaggtaagtgcggagagaaatggct

SEQ ID NO: 6500 - DNA, 32 bp, Artificial Sequence
  Synthetic polynucleotide
tgagcgatcaatgaccccagtaatagcctgaa

SEQ ID NO: 6501 - DNA, 32 bp, Artificial Sequence
  Synthetic polynucleotide
aatggtcgacaatatgtattaagttttcgccg

SEQ ID NO: 6502 - DNA, 32 bp, Artificial Sequence; identical to SEQ ID NO: 2024
  Synthetic polynucleotide

SEQ ID NO: 6503 - DNA, 32 bp, Artificial Sequence
  Synthetic polynucleotide
ccatcggcaaaattgagttaccgctataatta

SEQ ID NO: 6504 - DNA, 32 bp, Artificial Sequence
  Synthetic polynucleotide
tataattcatcctgtgcatggaagcagagttc

SEQ ID NO: 6505 - DNA, 32 bp, Artificial Sequence; identical to SEQ ID NO: 1018
  Synthetic polynucleotide

SEQ ID NO: 6506 - DNA, 32 bp, Artificial Sequence
  Synthetic polynucleotide
gtgagctcctacgtggaagtgttaatgccgag

SEQ ID NO: 6507 - DNA, 32 bp, Artificial Sequence
  Synthetic polynucleotide
cgcctaggctaacctcatgactccaggagagg

SEQ ID NO: 6508 - DNA, 32 bp, Artificial Sequence
  Synthetic polynucleotide
atctaacttgatttttattcagaatcgagacc

SEQ ID NO: 6509 - DNA, 32 bp, Artificial Sequence; identical to SEQ ID NO: 1022
  Synthetic polynucleotide

SEQ ID NO: 6510 - DNA, 32 bp, Artificial Sequence
  Synthetic polynucleotide
ttgctcttggacgtctcattctatagcccgcg

SEQ ID NO: 6511 - DNA, 48 bp, Artificial Sequence
  Synthetic polynucleotide
tgaacccttactatcgcgacaggataggtcaaaataaacgatacttaa

SEQ ID NO: 6512 - DNA, 32 bp, Artificial Sequence; identical to SEQ ID NO: 2034
  Synthetic polynucleotide

SEQ ID NO: 6513 - DNA, 16 bp, Artificial Sequence
  Synthetic polynucleotide
aaaacactcggcgagt

SEQ ID NO: 6514 - DNA, 48 bp, Artificial Sequence; identical to SEQ ID NO: 1026
  Synthetic polynucleotide

SEQ ID NO: 6515 - DNA, 32 bp, Artificial Sequence
  Synthetic polynucleotide
gttctagggagcggggatggtacacccagcat

SEQ ID NO: 6516 - DNA, 32 bp, Artificial Sequence; identical to SEQ ID NO: 4380
  Synthetic polynucleotide

SEQ ID NO: 6517 - DNA, 32 bp, Artificial Sequence; identical to SEQ ID NO: 4484
  Synthetic polynucleotide

SEQ ID NO: 6518 - DNA, 32 bp, Artificial Sequence; identical to SEQ ID NO: 3523
  Synthetic polynucleotide

SEQ ID NO: 6519 - DNA, 32 bp, Artificial Sequence; identical to SEQ ID NO: 3547
  Synthetic polynucleotide

SEQ ID NO: 6520 - DNA, 32 bp, Artificial Sequence; identical to SEQ ID NO: 3571
  Synthetic polynucleotide

SEQ ID NO: 6521 - DNA, 32 bp, Artificial Sequence; identical to SEQ ID NO: 4591
  Synthetic polynucleotide

SEQ ID NO: 6522 - DNA, 32 bp, Artificial Sequence; identical to SEQ ID NO: 2042
  Synthetic polynucleotide

SEQ ID NO: 6523 - DNA, 32 bp, Artificial Sequence; identical to SEQ ID NO: 4241
  Synthetic polynucleotide

SEQ ID NO: 6524 - DNA, 32 bp, Artificial Sequence; identical to SEQ ID NO: 3595
  Synthetic polynucleotide

SEQ ID NO: 6525 - DNA, 32 bp, Artificial Sequence; identical to SEQ ID NO: 3619
  Synthetic polynucleotide

SEQ ID NO: 6526 - DNA, 32 bp, Artificial Sequence; identical to SEQ ID NO: 2046
  Synthetic polynucleotide

SEQ ID NO: 6527 - DNA, 32 bp, Artificial Sequence; identical to SEQ ID NO: 3691
  Synthetic polynucleotide

SEQ ID NO: 6528 - DNA, 32 bp, Artificial Sequence; identical to SEQ ID NO: 2047
  Synthetic polynucleotide

SEQ ID NO: 6529 - DNA, 48 bp, Artificial Sequence
  Synthetic polynucleotide
gcatcagctggcaggtgccatcctacccgctttctcatgcgaagcagg

SEQ ID NO: 6530 - DNA, 16 bp, Artificial Sequence
  Synthetic polynucleotide
cttcaataagttgtag

SEQ ID NO: 6531 - DNA, 48 bp, Artificial Sequence
  Synthetic polynucleotide
atgtgtaatggtgggcggacgatatctgcgccagcgccacgtccccaa

SEQ ID NO: 6532 - DNA, 32 bp, Artificial Sequence
  Synthetic polynucleotide
cctgggtcctgctgccgccctttggggttcac

SEQ ID NO: 6533 - DNA, 32 bp, Artificial Sequence
  Synthetic polynucleotide
ttgtcgggacctgtcattggagtgatgaacaa

SEQ ID NO: 6534 - DNA, 32 bp, Artificial Sequence; identical to SEQ ID NO: 5831
  Synthetic polynucleotide

SEQ ID NO: 6535 - DNA, 32 bp, Artificial Sequence
  Synthetic polynucleotide
gtattccatccagctgacggtatggaaagaag

SEQ ID NO: 6536 - DNA, 32 bp, Artificial Sequence
  Synthetic polynucleotide
gtatgtgaaagagtcaagcgtaaagtcttgac

SEQ ID NO: 6537 - DNA, 32 bp, Artificial Sequence
  Synthetic polynucleotide
cgaaggggctcgagtctacagcagagctacgc

SEQ ID NO: 6538 - DNA, 32 bp, Artificial Sequence; identical to SEQ ID NO: 5835
  Synthetic polynucleotide

SEQ ID NO: 6539 - DNA, 32 bp, Artificial Sequence
  Synthetic polynucleotide
gtcccacgtctttaaatgtcccgtgttagggc

SEQ ID NO: 6540 - DNA, 32 bp, Artificial Sequence
  Synthetic polynucleotide
cccttagccgtacaaagcgttactgacccgct

SEQ ID NO: 6541 - DNA, 32 bp, Artificial Sequence
  Synthetic polynucleotide
aggagcagtttgggtctacggcaccgaggcct

SEQ ID NO: 6542 - DNA, 32 bp, Artificial Sequence
  Synthetic polynucleotide
gcaggtaaatgcaaaactatgtctttctgagg

SEQ ID NO: 6543 - DNA, 32 bp, Artificial Sequence
  Synthetic polynucleotide
aatccgatgaccctaagagtccccgaagaata

SEQ ID NO: 6544 - DNA, 32 bp, Artificial Sequence
  Synthetic polynucleotide
aaaagcagtcaaccggcgacgagtaacggcat

SEQ ID NO: 6545 - DNA, 32 bp, Artificial Sequence; identical to SEQ ID NO: 2062
  Synthetic polynucleotide

SEQ ID NO: 6546 - DNA, 48 bp, Artificial Sequence
  Synthetic polynucleotide
cttccgactttttataactgctgggtgggcgcgagaccaggcgtccgg

SEQ ID NO: 6547 - DNA, 32 bp, Artificial Sequence; identical to SEQ ID NO: 4381
  Synthetic polynucleotide

SEQ ID NO: 6548 - DNA, 16 bp, Artificial Sequence
  Synthetic polynucleotide
tatgagttaccctgca

SEQ ID NO: 6549 - DNA, 48 bp, Artificial Sequence; identical to SEQ ID NO: 2067
  Synthetic polynucleotide

SEQ ID NO: 6550 - DNA, 32 bp, Artificial Sequence; identical to SEQ ID NO: 2066
  Synthetic polynucleotide

SEQ ID NO: 6551 - DNA, 32 bp, Artificial Sequence; identical to SEQ ID NO: 2068
  Synthetic polynucleotide

SEQ ID NO: 6552 - DNA, 32 bp, Artificial Sequence; identical to SEQ ID NO: 2070
  Synthetic polynucleotide

SEQ ID NO: 6553 - DNA, 32 bp, Artificial Sequence; identical to SEQ ID NO: 2069
  Synthetic polynucleotide

SEQ ID NO: 6554 - DNA, 32 bp, Artificial Sequence; identical to SEQ ID NO: 2071
  Synthetic polynucleotide

SEQ ID NO: 6555 - DNA, 32 bp, Artificial Sequence; identical to SEQ ID NO: 2073
  Synthetic polynucleotide

SEQ ID NO: 6556 - DNA, 32 bp, Artificial Sequence; identical to SEQ ID NO: 2072
  Synthetic polynucleotide

SEQ ID NO: 6557 - DNA, 32 bp, Artificial Sequence; identical to SEQ ID NO: 2074
  Synthetic polynucleotide

SEQ ID NO: 6558 - DNA, 32 bp, Artificial Sequence; identical to SEQ ID NO: 2076
  Synthetic polynucleotide

SEQ ID NO: 6559 - DNA, 32 bp, Artificial Sequence; identical to SEQ ID NO: 2075
  Synthetic polynucleotide

SEQ ID NO: 6560 - DNA, 32 bp, Artificial Sequence; identical to SEQ ID NO: 3650
  Synthetic polynucleotide

SEQ ID NO: 6561 - DNA, 32 bp, Artificial Sequence; identical to SEQ ID NO: 4337
  Synthetic polynucleotide

SEQ ID NO: 6562 - DNA, 32 bp, Artificial Sequence; identical to SEQ ID NO: 4057
  Synthetic polynucleotide

SEQ ID NO: 6563 - DNA, 32 bp, Artificial Sequence; identical to SEQ ID NO: 3664
  Synthetic polynucleotide

SEQ ID NO: 6564 - DNA, 48 bp, Artificial Sequence; identical to SEQ ID NO: 2080
  Synthetic polynucleotide

SEQ ID NO: 6565 - DNA, 16 bp, Artificial Sequence
  Synthetic polynucleotide
ctcagtttaagattca

SEQ ID NO: 6566 - DNA, 16 bp, Artificial Sequence
  Synthetic polynucleotide
gtatgatttttttttt

SEQ ID NO: 6567 - DNA, 16 bp, Artificial Sequence
  Synthetic polynucleotide
gatacttttttttttt

SEQ ID NO: 6568 - DNA, 16 bp, Artificial Sequence
  Synthetic polynucleotide
gcaccgaatttttttt

SEQ ID NO: 6569 - DNA, 16 bp, Artificial Sequence
  Synthetic polynucleotide
tagcccggtttttttt

SEQ ID NO: 6570 - DNA, 16 bp, Artificial Sequence
  Synthetic polynucleotide
ggcatcactttttttt

SEQ ID NO: 6571 - DNA, 16 bp, Artificial Sequence
  Synthetic polynucleotide
ttcttaaatttttttt

SEQ ID NO: 6572 - DNA, 48 bp, Artificial Sequence
  Synthetic polynucleotide
ctatcttcataggacacaacagttaaccgtgaggcgcatatgagcttt

SEQ ID NO: 6573 - DNA, 32 bp, Artificial Sequence
  Synthetic polynucleotide
tttttttttatgctctgtttgaactttttttt

SEQ ID NO: 6574 - DNA, 48 bp, Artificial Sequence
  Synthetic polynucleotide
atgaacacgtgcgttgagttcgtagagatgcgcccccaagacgcttag

SEQ ID NO: 6575 - DNA, 32 bp, Artificial Sequence
  Synthetic polynucleotide
tttttttttactctgagatagctgtttttttt

SEQ ID NO: 6576 - DNA, 48 bp, Artificial Sequence
  Synthetic polynucleotide
aacagcatgaaaaggcgacatgaacccgctgccccagtgagctcgaca

SEQ ID NO: 6577 - DNA, 32 bp, Artificial Sequence
  Synthetic polynucleotide
ttttttttcccgcaactctttctctttttttt

SEQ ID NO: 6578 - DNA, 48 bp, Artificial Sequence
  Synthetic polynucleotide
acactgacaaaagcccgggctgatggcttcatgccggagtagacgtgc

SEQ ID NO: 6579 - DNA, 32 bp, Artificial Sequence
  Synthetic polynucleotide
tttttttttcgcgatcaacagtcctttttttt

SEQ ID NO: 6580 - DNA, 48 bp, Artificial Sequence
  Synthetic polynucleotide
tagctccgctcccggtgcatcagaacccttttctcgacggttaatttg

SEQ ID NO: 6581 - DNA, 32 bp, Artificial Sequence
  Synthetic polynucleotide
ttttttttaggtcaggctttaggctttttttt

SEQ ID NO: 6582 - DNA, 48 bp, Artificial Sequence
  Synthetic polynucleotide
agatgttcctagaaatcagagccgtgcgatcacaccagaaatagccag

SEQ ID NO: 6583 - DNA, 32 bp, Artificial Sequence
  Synthetic polynucleotide
ttttttttcaaccaaaccagccgctttttttt

SEQ ID NO: 6584 - DNA, 48 bp, Artificial Sequence
  Synthetic polynucleotide
ctttacgcttttttttttttttttggggatgaatccttccgtgggacg

SEQ ID NO: 6585 - DNA, 48 bp, Artificial Sequence
  Synthetic polynucleotide
agcttgggctgacagatatgattgaacatctcaaagactgtttttttt

SEQ ID NO: 6586 - DNA, 48 bp, Artificial Sequence
  Synthetic polynucleotide
gagtcggcttttttttttttttttcctagctagagggaacttccagct

SEQ ID NO: 6587 - DNA, 48 bp, Artificial Sequence
  Synthetic polynucleotide
cgcacggcgaagcgtaccatatccccattataccaggtcatttttttt

SEQ ID NO: 6588 - DNA, 48 bp, Artificial Sequence
  Synthetic polynucleotide
cgtttgtcttttttttttttttttgttccggttcagaaaccagtctct

SEQ ID NO: 6589 - DNA, 48 bp, Artificial Sequence
  Synthetic polynucleotide
attaccgttcgttcgaggggtcacacagctaagtggctggtttttttt

SEQ ID NO: 6590 - DNA, 48 bp, Artificial Sequence
  Synthetic polynucleotide
ctaatatattttttttttttttttgcggccatatttccgctaagcgtt

SEQ ID NO: 6591 - DNA, 48 bp, Artificial Sequence
  Synthetic polynucleotide
ccaagtcacagaagtgacaggcggcgctcagcgtattagctttttttt

SEQ ID NO: 6592 - DNA, 48 bp, Artificial Sequence
  Synthetic polynucleotide
agtttccttttttttttttttttttccggtttagcgaatttactcgat

SEQ ID NO: 6593 - DNA, 48 bp, Artificial Sequence
  Synthetic polynucleotide
aactactggtttccttcactgagtaagtgtgtcaccgttctttttttt

SEQ ID NO: 6594 - DNA, 48 bp, Artificial Sequence
  Synthetic polynucleotide
ttagtgagttttttttttttttttgagccacttaacctggccatccct

SEQ ID NO: 6595 - DNA, 48 bp, Artificial Sequence
  Synthetic polynucleotide
cttacatcctgtttacaagtaaacttgagactacccgagctttttttt

SEQ ID NO: 6596 - DNA, 32 bp, Artificial Sequence
  Synthetic polynucleotide
catctttttgcgagatgtgggtaaaccatacc

SEQ ID NO: 6597 - DNA, 32 bp, Artificial Sequence
  Synthetic polynucleotide
ttttttttttatgctataattagttttttttt

SEQ ID NO: 6598 - DNA, 32 bp, Artificial Sequence
  Synthetic polynucleotide
atcgactagcttgaacgaggcggcatcgggtt

SEQ ID NO: 6599 - DNA, 32 bp, Artificial Sequence
  Synthetic polynucleotide
tttttttttcagtcgtagtacgactttttttt

SEQ ID NO: 6600 - DNA, 32 bp, Artificial Sequence
  Synthetic polynucleotide
cgagtcgtaggatatggcggaacccttgcctc

SEQ ID NO: 6601 - DNA, 32 bp, Artificial Sequence
  Synthetic polynucleotide
ttttttttcacccccgaggtggcctttttttt

SEQ ID NO: 6602 - DNA, 32 bp, Artificial Sequence
  Synthetic polynucleotide
gtcgctggtgggtaagggtacacggcctgttt

SEQ ID NO: 6603 - DNA, 32 bp, Artificial Sequence
  Synthetic polynucleotide
ttttttttaacctcgttaggttaatttttttt

SEQ ID NO: 6604 - DNA, 32 bp, Artificial Sequence
  Synthetic polynucleotide
tggagttagcccctcggctatgctaggtagag

SEQ ID NO: 6605 - DNA, 32 bp, Artificial Sequence
  Synthetic polynucleotide
ttttttttctaatcacgttatttctttttttt

SEQ ID NO: 6606 - DNA, 32 bp, Artificial Sequence
  Synthetic polynucleotide
aattctcagaaggagtagctgttcatcatggt

SEQ ID NO: 6607 - DNA, 32 bp, Artificial Sequence
  Synthetic polynucleotide
ttttttttgatgtccgtgacgatctttttttt

SEQ ID NO: 6608 - DNA, 32 bp, Artificial Sequence
  Synthetic polynucleotide
gaacttgattttttttttttttttggatatcg

SEQ ID NO: 6609 - DNA, 32 bp, Artificial Sequence
  Synthetic polynucleotide
agattgtatccccgtcggtcagaagcccccta

SEQ ID NO: 6610 - DNA, 32 bp, Artificial Sequence
  Synthetic polynucleotide
cctatcttttttttttttttttttgtatatca

SEQ ID NO: 6611 - DNA, 32 bp, Artificial Sequence
  Synthetic polynucleotide
ctcgtgctttcataactcacattagaatatgg

SEQ ID NO: 6612 - DNA, 32 bp, Artificial Sequence
  Synthetic polynucleotide
ctaacgatttttttttttttttttgtatagcg

SEQ ID NO: 6613 - DNA, 32 bp, Artificial Sequence
  Synthetic polynucleotide
atcagttaacgcttacgacagggaccaccgca

SEQ ID NO: 6614 - DNA, 32 bp, Artificial Sequence
  Synthetic polynucleotide
gaccatagttttttttttttttttccaaggag

SEQ ID NO: 6615 - DNA, 32 bp, Artificial Sequence
  Synthetic polynucleotide
gggcactcgtgggaggcacgcgagctatgtag

SEQ ID NO: 6616 - DNA, 32 bp, Artificial Sequence
  Synthetic polynucleotide
cttgacgattttttttttttttttgcgcaggg

SEQ ID NO: 6617 - DNA, 32 bp, Artificial Sequence
  Synthetic polynucleotide
tcccacgttgtttcacgcgggccgggaaggac

SEQ ID NO: 6618 - DNA, 32 bp, Artificial Sequence
  Synthetic polynucleotide
cacttgagttttttttttttttttagttttgg

SEQ ID NO: 6619 - DNA, 32 bp, Artificial Sequence
  Synthetic polynucleotide
cgtgcacatcacgtggataatagtggggtcgt

SEQ ID NO: 6620 - DNA, 32 bp, Artificial Sequence
  Synthetic polynucleotide
cataggtagcgtatccggcggtaccaaacatt

SEQ ID NO: 6621 - DNA, 32 bp, Artificial Sequence
  Synthetic polynucleotide
ttttttttttacttcgaataaggatttttttt

SEQ ID NO: 6622 - DNA, 32 bp, Artificial Sequence
  Synthetic polynucleotide
tcatccgggctgtgacgtgtcaagggaagttc

SEQ ID NO: 6623 - DNA, 32 bp, Artificial Sequence
  Synthetic polynucleotide
tttttttttgataatctcatacgatttttttt

SEQ ID NO: 6624 - DNA, 32 bp, Artificial Sequence
  Synthetic polynucleotide
gtccaacatcgagaaaggtacacctcacttgc

SEQ ID NO: 6625 - DNA, 32 bp, Artificial Sequence
  Synthetic polynucleotide
ttttttttaggagaaaatctggtctttttttt

SEQ ID NO: 6626 - DNA, 32 bp, Artificial Sequence
  Synthetic polynucleotide
ctaccgctatattaagcgcccactctatgaac

SEQ ID NO: 6627 - DNA, 32 bp, Artificial Sequence
  Synthetic polynucleotide
tttttttttgccgaggcagcccattttttttt

SEQ ID NO: 6628 - DNA, 32 bp, Artificial Sequence
  Synthetic polynucleotide
cctctcccaaagcaggtgcccatggtgacacg

SEQ ID NO: 6629 - DNA, 32 bp, Artificial Sequence
  Synthetic polynucleotide
tttttttttcgggcacgacgaggttttttttt

SEQ ID NO: 6630 - DNA, 32 bp, Artificial Sequence
  Synthetic polynucleotide
aatgcacaactgttagatgtagcaagtgcgta

SEQ ID NO: 6631 - DNA, 32 bp, Artificial Sequence
  Synthetic polynucleotide
ttttttttatccctgacctacaattttttttt

SEQ ID NO: 6632 - DNA, 32 bp, Artificial Sequence
  Synthetic polynucleotide
cggtgagattttttttttttttttacaacata

SEQ ID NO: 6633 - DNA, 32 bp, Artificial Sequence
  Synthetic polynucleotide
gcaattgcctaatccctcagacgcgttatgga

SEQ ID NO: 6634 - DNA, 32 bp, Artificial Sequence
  Synthetic polynucleotide
gagtgcaattttttttttttttttgtataacc

SEQ ID NO: 6635 - DNA, 32 bp, Artificial Sequence
  Synthetic polynucleotide
cgaatcaagtccctcaagctatggttgcttta

SEQ ID NO: 6636 - DNA, 32 bp, Artificial Sequence
  Synthetic polynucleotide
caggctacttttttttttttttttatcagcta

SEQ ID NO: 6637 - DNA, 32 bp, Artificial Sequence
  Synthetic polynucleotide
tatggtttttccgccccgagggttcccgagcc

SEQ ID NO: 6638 - DNA, 32 bp, Artificial Sequence
  Synthetic polynucleotide
aatgattatttttttttttttttttatttcga

SEQ ID NO: 6639 - DNA, 32 bp, Artificial Sequence
  Synthetic polynucleotide
actgtacggaccaagtcggaacagccaaggca

SEQ ID NO: 6640 - DNA, 32 bp, Artificial Sequence
  Synthetic polynucleotide
ctcggcccttttttttttttttttcgcagggt

SEQ ID NO: 6641 - DNA, 32 bp, Artificial Sequence
  Synthetic polynucleotide
tggtggttcagtagaagtattactttctggtc

SEQ ID NO: 6642 - DNA, 32 bp, Artificial Sequence
  Synthetic polynucleotide
tactaaaattttttttttttttttctgctcta

SEQ ID NO: 6643 - DNA, 32 bp, Artificial Sequence
  Synthetic polynucleotide
tagtttgataagccacgtcgcatatatcccaa

SEQ ID NO: 6644 - DNA, 32 bp, Artificial Sequence
  Synthetic polynucleotide
tccaaaccacggccaccgtcgtctaggacgat

SEQ ID NO: 6645 - DNA, 32 bp, Artificial Sequence
  Synthetic polynucleotide
ttttttttgcaacctatatttgactttttttt

SEQ ID NO: 6646 - DNA, 32 bp, Artificial Sequence
  Synthetic polynucleotide
atatcaagttccccaggtaaacgataggtttc

SEQ ID NO: 6647 - DNA, 32 bp, Artificial Sequence
  Synthetic polynucleotide
tttttttttatgtgattcgcaacgtttttttt

SEQ ID NO: 6648 - DNA, 32 bp, Artificial Sequence
  Synthetic polynucleotide
ctaatgaagcgcgcctacttgggattaggatc

SEQ ID NO: 6649 - DNA, 32 bp, Artificial Sequence
  Synthetic polynucleotide
ttttttttgccctcagagcctacgtttttttt

SEQ ID NO: 6650 - DNA, 32 bp, Artificial Sequence
  Synthetic polynucleotide
catatattggagcactgattgccgtaaatggt

SEQ ID NO: 6651 - DNA, 32 bp, Artificial Sequence
  Synthetic polynucleotide
ttttttttggttggttttggctgatttttttt

SEQ ID NO: 6652 - DNA, 32 bp, Artificial Sequence
  Synthetic polynucleotide
cgaccatggcccagcgccgcacgtcccccgca

SEQ ID NO: 6653 - DNA, 32 bp, Artificial Sequence
  Synthetic polynucleotide
ttttttttgaggatgtgccactactttttttt

SEQ ID NO: 6654 - DNA, 32 bp, Artificial Sequence
  Synthetic polynucleotide
gcggccattgggtgttcgtcttaaccattacg

SEQ ID NO: 6655 - DNA, 32 bp, Artificial Sequence
  Synthetic polynucleotide
ttttttttgctgtatttttttgtctttttttt

SEQ ID NO: 6656 - DNA, 32 bp, Artificial Sequence
  Synthetic polynucleotide
atgtggttttttttttttttttttcaagaact

SEQ ID NO: 6657 - DNA, 32 bp, Artificial Sequence
  Synthetic polynucleotide
ccccggtatgactaccggaatgcacgatcgcc

SEQ ID NO: 6658 - DNA, 32 bp, Artificial Sequence
  Synthetic polynucleotide
ggcgatacttttttttttttttttattgaaag

SEQ ID NO: 6659 - DNA, 32 bp, Artificial Sequence
  Synthetic polynucleotide
tagtccacgggtatagagctctgttcctatga

SEQ ID NO: 6660 - DNA, 32 bp, Artificial Sequence
  Synthetic polynucleotide
gaggtagctttttttttttttttttacccaca

SEQ ID NO: 6661 - DNA, 32 bp, Artificial Sequence
  Synthetic polynucleotide
cgagatgtagtggagcacatgtaatctagcag

SEQ ID NO: 6662 - DNA, 32 bp, Artificial Sequence
  Synthetic polynucleotide
ttccttttttttttttttttttttgccgatct

SEQ ID NO: 6663 - DNA, 32 bp, Artificial Sequence
  Synthetic polynucleotide
tggatatcgcactgcctaactaagtggggcac

SEQ ID NO: 6664 - DNA, 32 bp, Artificial Sequence
  Synthetic polynucleotide
actctcgtttttttttttttttttagctttat

SEQ ID NO: 6665 - DNA, 32 bp, Artificial Sequence
  Synthetic polynucleotide
cgaatcgcaggtctacgtgcagctatccgaat

SEQ ID NO: 6666 - DNA, 32 bp, Artificial Sequence
  Synthetic polynucleotide
cggcatgcttttttttttttttttagaaactg

SEQ ID NO: 6667 - DNA, 32 bp, Artificial Sequence
  Synthetic polynucleotide
gcgttaaaatcttagtagtatagtaaattgtg

SEQ ID NO: 6668 - DNA, 32 bp, Artificial Sequence
  Synthetic polynucleotide
ggaggcggacgactttgcagtccgatgttggg

SEQ ID NO: 6669 - DNA, 32 bp, Artificial Sequence
  Synthetic polynucleotide
ttttttttgctgttcaagttactgtttttttt

SEQ ID NO: 6670 - DNA, 32 bp, Artificial Sequence
  Synthetic polynucleotide
actttctgatacacaagcctggccctacttca

SEQ ID NO: 6671 - DNA, 32 bp, Artificial Sequence
  Synthetic polynucleotide
ttttttttgcgctttcgatgctattttttttt

SEQ ID NO: 6672 - DNA, 32 bp, Artificial Sequence
  Synthetic polynucleotide
gctcgaccgcgtatcgtacttgaattacttgg

SEQ ID NO: 6673 - DNA, 32 bp, Artificial Sequence
  Synthetic polynucleotide
ttttttttcacctttccactcgcatttttttt

SEQ ID NO: 6674 - DNA, 32 bp, Artificial Sequence
  Synthetic polynucleotide
cctactcttctcataacgtacgcatacgattt

SEQ ID NO: 6675 - DNA, 32 bp, Artificial Sequence
  Synthetic polynucleotide
ttttttttatgtaccgagaaccggtttttttt

SEQ ID NO: 6676 - DNA, 32 bp, Artificial Sequence
  Synthetic polynucleotide
cagaaactatgccagcgtgggagatgtcaagt

SEQ ID NO: 6677 - DNA, 32 bp, Artificial Sequence
  Synthetic polynucleotide
ttttttttgctacatgccatgaaatttttttt

SEQ ID NO: 6678 - DNA, 32 bp, Artificial Sequence
  Synthetic polynucleotide
ccccaagtggtgctactgattagcgcttaggg

SEQ ID NO: 6679 - DNA, 32 bp, Artificial Sequence
  Synthetic polynucleotide
ttttttttggtctaaatcgtacagtttttttt

SEQ ID NO: 6680 - DNA, 32 bp, Artificial Sequence
  Synthetic polynucleotide
tcaagctgttttttttttttttttaggagatc

SEQ ID NO: 6681 - DNA, 32 bp, Artificial Sequence
  Synthetic polynucleotide
ggaacttgtaacccttctcgttcgagcacgca

SEQ ID NO: 6682 - DNA, 32 bp, Artificial Sequence
  Synthetic polynucleotide
ctaggacctttttttttttttttttccgtgca

SEQ ID NO: 6683 - DNA, 32 bp, Artificial Sequence
  Synthetic polynucleotide
tcaaggccaaagatactcttgcttgcgaaaat

SEQ ID NO: 6684 - DNA, 32 bp, Artificial Sequence
  Synthetic polynucleotide
tgctggtgttttttttttttttttttacttgc

SEQ ID NO: 6685 - DNA, 32 bp, Artificial Sequence
  Synthetic polynucleotide
aacggcgaggggcataccacatgaaccgctct

SEQ ID NO: 6686 - DNA, 32 bp, Artificial Sequence
  Synthetic polynucleotide
tacgctatttttttttttttttttgatattca

SEQ ID NO: 6687 - DNA, 32 bp, Artificial Sequence
  Synthetic polynucleotide
ccagtccctcgcgtcgtctggttccccactgt

SEQ ID NO: 6688 - DNA, 32 bp, Artificial Sequence
  Synthetic polynucleotide
cggggaggttttttttttttttttaggagaag

SEQ ID NO: 6689 - DNA, 32 bp, Artificial Sequence
  Synthetic polynucleotide
aattcatcggctagaaagagtatagatggccg

SEQ ID NO: 6690 - DNA, 32 bp, Artificial Sequence
  Synthetic polynucleotide
gcgccagattttttttttttttttacaccggc

SEQ ID NO: 6691 - DNA, 32 bp, Artificial Sequence
  Synthetic polynucleotide
agcaggtcgctgaggattccgcgtcaaatctg

SEQ ID NO: 6692 - DNA, 32 bp, Artificial Sequence
  Synthetic polynucleotide
actacgctgtcttgcgcagagcgtcgggaatt

SEQ ID NO: 6693 - DNA, 32 bp, Artificial Sequence
  Synthetic polynucleotide
ttttttttccgccgcaccgagatttttttttt

SEQ ID NO: 6694 - DNA, 32 bp, Artificial Sequence
  Synthetic polynucleotide
tgtactactctgcaacaccagttccacaaggg

SEQ ID NO: 6695 - DNA, 32 bp, Artificial Sequence
  Synthetic polynucleotide
ttttttttatgtcatgcacgacgatttttttt

SEQ ID NO: 6696 - DNA, 32 bp, Artificial Sequence
  Synthetic polynucleotide
acgactctcgacatcctcacagtgtggtgaat

SEQ ID NO: 6697 - DNA, 32 bp, Artificial Sequence
  Synthetic polynucleotide
ttttttttcgcgagcaggagaatctttttttt

SEQ ID NO: 6698 - DNA, 32 bp, Artificial Sequence
  Synthetic polynucleotide
tacatacggtccggtcgcctgtgataattccc

SEQ ID NO: 6699 - DNA, 32 bp, Artificial Sequence
  Synthetic polynucleotide
ttttttttcatctgatgaggtggttttttttt

SEQ ID NO: 6700 - DNA, 32 bp, Artificial Sequence
  Synthetic polynucleotide
aaagcttcttgtaatgagacactacccgctcg

SEQ ID NO: 6701 - DNA, 32 bp, Artificial Sequence
  Synthetic polynucleotide
ttttttttccgaacgagcttctcgtttttttt

SEQ ID NO: 6702 - DNA, 32 bp, Artificial Sequence
  Synthetic polynucleotide
cgtcacttgtcctcactttcaactctgaagcg

SEQ ID NO: 6703 - DNA, 32 bp, Artificial Sequence
  Synthetic polynucleotide
tttttttttgtcgaaaattaatactttttttt

SEQ ID NO: 6704 - DNA, 32 bp, Artificial Sequence
  Synthetic polynucleotide
tgcttatctttttttttttttttttccagaat

SEQ ID NO: 6705 - DNA, 32 bp, Artificial Sequence
  Synthetic polynucleotide
aaaccgtttcttgccaagcacgtagttaatgc

SEQ ID NO: 6706 - DNA, 32 bp, Artificial Sequence
  Synthetic polynucleotide
atagaatattttttttttttttttcttagatc

SEQ ID NO: 6707 - DNA, 32 bp, Artificial Sequence
  Synthetic polynucleotide
cgcggaacggtccggcacttacgtgtagtgtc

SEQ ID NO: 6708 - DNA, 32 bp, Artificial Sequence
  Synthetic polynucleotide
aattcatatttttttttttttttttcaccgaa

SEQ ID NO: 6709 - DNA, 32 bp, Artificial Sequence
  Synthetic polynucleotide
tgcggcgctaggtcactaagcgcgcacccgtt

SEQ ID NO: 6710 - DNA, 32 bp, Artificial Sequence
  Synthetic polynucleotide
tcctcggtttttttttttttttttataaaagc

SEQ ID NO: 6711 - DNA, 32 bp, Artificial Sequence
  Synthetic polynucleotide
accgaagcttgccaccacggggttactctagc

SEQ ID NO: 6712 - DNA, 32 bp, Artificial Sequence
  Synthetic polynucleotide
acactaatttttttttttttttttttggacgg

SEQ ID NO: 6713 - DNA, 32 bp, Artificial Sequence
  Synthetic polynucleotide
ccccggaaagggtgtatgtgggctcatcgccg

SEQ ID NO: 6714 - DNA, 32 bp, Artificial Sequence
  Synthetic polynucleotide
gctctaaattttttttttttttttctgcccag

SEQ ID NO: 6715 - DNA, 32 bp, Artificial Sequence
  Synthetic polynucleotide
ctggttttccgggtatggtaggttggactcat

SEQ ID NO: 6716 - DNA, 32 bp, Artificial Sequence
  Synthetic polynucleotide
gttatacaggtccttcagtgtctcaatggcaa

SEQ ID NO: 6717 - DNA, 32 bp, Artificial Sequence
  Synthetic polynucleotide
ttttttttggtccgggtaccgagctttttttt

SEQ ID NO: 6718 - DNA, 32 bp, Artificial Sequence
  Synthetic polynucleotide
tatcctttatggtttcgatgaacacatttctt

SEQ ID NO: 6719 - DNA, 32 bp, Artificial Sequence
  Synthetic polynucleotide
ttttttttgctattcgcagtgcggtttttttt

SEQ ID NO: 6720 - DNA, 32 bp, Artificial Sequence
  Synthetic polynucleotide
aacagtgatttaaaccagtaattgtcgctttt

SEQ ID NO: 6721 - DNA, 32 bp, Artificial Sequence
  Synthetic polynucleotide
ttttttttaatgggtaaggaggtgtttttttt

SEQ ID NO: 6722 - DNA, 32 bp, Artificial Sequence
  Synthetic polynucleotide
tgtcgtatcctgcgaaaccaatcataatgatc

SEQ ID NO: 6723 - DNA, 32 bp, Artificial Sequence
  Synthetic polynucleotide
ttttttttagacctgtttctgctatttttttt

SEQ ID NO: 6724 - DNA, 32 bp, Artificial Sequence
  Synthetic polynucleotide
tacgagcttgctgggtccgtaatcacggtatt

SEQ ID NO: 6725 - DNA, 32 bp, Artificial Sequence
  Synthetic polynucleotide
ttttttttttgatttaaagcctgatttttttt

SEQ ID NO: 6726 - DNA, 32 bp, Artificial Sequence
  Synthetic polynucleotide
cccgagtcacggccgggattgggtatgaaaac

SEQ ID NO: 6727 - DNA, 32 bp, Artificial Sequence
  Synthetic polynucleotide
ttttttttgattgcgcgataatactttttttt

SEQ ID NO: 6728 - DNA, 32 bp, Artificial Sequence
  Synthetic polynucleotide
tgccatgattttttttttttttttgtttggaa

SEQ ID NO: 6729 - DNA, 32 bp, Artificial Sequence
  Synthetic polynucleotide
ccgaattactgtgctctataaagctaaggaat

SEQ ID NO: 6730 - DNA, 32 bp, Artificial Sequence
  Synthetic polynucleotide
ccctccacttttttttttttttttggtgatct

SEQ ID NO: 6731 - DNA, 32 bp, Artificial Sequence
  Synthetic polynucleotide
ccatatgacagctccaagccgaaccagcatta

SEQ ID NO: 6732 - DNA, 32 bp, Artificial Sequence
  Synthetic polynucleotide
caattcccttttttttttttttttgtggaaat

SEQ ID NO: 6733 - DNA, 32 bp, Artificial Sequence
  Synthetic polynucleotide
caacatttgtcaacttcccatggagctgccat

SEQ ID NO: 6734 - DNA, 32 bp, Artificial Sequence
  Synthetic polynucleotide
actcgctattttttttttttttttcgtagttc

SEQ ID NO: 6735 - DNA, 32 bp, Artificial Sequence
  Synthetic polynucleotide
attcggatctaggtgggaggagcgtgacatcg

SEQ ID NO: 6736 - DNA, 32 bp, Artificial Sequence
  Synthetic polynucleotide
tgttttcgttttttttttttttttgacttgat

SEQ ID NO: 6737 - DNA, 32 bp, Artificial Sequence
  Synthetic polynucleotide
cgggtgtccacaacttacccgagaatctatac

SEQ ID NO: 6738 - DNA, 32 bp, Artificial Sequence
  Synthetic polynucleotide
gaaaactgttttttttttttttttgagataat

SEQ ID NO: 6739 - DNA, 32 bp, Artificial Sequence
  Synthetic polynucleotide
gtgcatctaaagtattgccttgtcggcgcggc

SEQ ID NO: 6740 - DNA, 32 bp, Artificial Sequence
  Synthetic polynucleotide
tctgatatttcgtttatcctgtcgcgatagta

SEQ ID NO: 6741 - DNA, 32 bp, Artificial Sequence
  Synthetic polynucleotide
ttttttttgccgggctctagagcttttttttt

SEQ ID NO: 6742 - DNA, 32 bp, Artificial Sequence
  Synthetic polynucleotide
tctgatggaataacttagttagatagacgtcc

SEQ ID NO: 6743 - DNA, 32 bp, Artificial Sequence
  Synthetic polynucleotide
tttttttttggtgtgtctagtaactttttttt

SEQ ID NO: 6744 - DNA, 32 bp, Artificial Sequence
  Synthetic polynucleotide
tgatcctgcttgtactaatgttctgaggttag

SEQ ID NO: 6745 - DNA, 32 bp, Artificial Sequence
  Synthetic polynucleotide
ttttttttatctcagcgagctcactttttttt

SEQ ID NO: 6746 - DNA, 32 bp, Artificial Sequence
  Synthetic polynucleotide
tggctcgttatctcttgcagggtgcacaggat

SEQ ID NO: 6747 - DNA, 32 bp, Artificial Sequence
  Synthetic polynucleotide
ttttttttcgtaccttgccgatggtttttttt

SEQ ID NO: 6748 - DNA, 32 bp, Artificial Sequence
  Synthetic polynucleotide
ttatcatgtatgccctgggagctgcatattgt

SEQ ID NO: 6749 - DNA, 32 bp, Artificial Sequence
  Synthetic polynucleotide
ttttttttacccatccatcgctcatttttttt

SEQ ID NO: 6750 - DNA, 32 bp, Artificial Sequence
  Synthetic polynucleotide
aattagaacctcaagcttatattacggtttac

SEQ ID NO: 6751 - DNA, 32 bp, Artificial Sequence
  Synthetic polynucleotide
ttttttttgagaaccgccacaaagtttttttt

SEQ ID NO: 6752 - DNA, 32 bp, Artificial Sequence
  Synthetic polynucleotide
cgctgatcttttttttttttttttagtaaatg

SEQ ID NO: 6753 - DNA, 32 bp, Artificial Sequence
  Synthetic polynucleotide
acctatatcaaaagattactggagacatggtc

SEQ ID NO: 6754 - DNA, 32 bp, Artificial Sequence
  Synthetic polynucleotide
ctctccgcttttttttttttttttgggtgacc

SEQ ID NO: 6755 - DNA, 32 bp, Artificial Sequence
  Synthetic polynucleotide
attactggtattggccggactatttcagattc

SEQ ID NO: 6756 - DNA, 32 bp, Artificial Sequence
  Synthetic polynucleotide
ggtagaagttttttttttttttttgtacaaat

SEQ ID NO: 6757 - DNA, 32 bp, Artificial Sequence
  Synthetic polynucleotide
gcggtaaccggcgaaacgttactgaccctaac

SEQ ID NO: 6758 - DNA, 32 bp, Artificial Sequence
  Synthetic polynucleotide
gaccacgttttttttttttttttttacactaa

SEQ ID NO: 6759 - DNA, 32 bp, Artificial Sequence
  Synthetic polynucleotide
taacacttgaactctgctcccacagcaaatta

SEQ ID NO: 6760 - DNA, 32 bp, Artificial Sequence
  Synthetic polynucleotide
ttctgaatttttttttttttttttctaagccg

SEQ ID NO: 6761 - DNA, 32 bp, Artificial Sequence
  Synthetic polynucleotide
cgtaggagcctctcctcttcgtcatgacggag

SEQ ID NO: 6762 - DNA, 32 bp, Artificial Sequence
  Synthetic polynucleotide
cgtttattttttttttttttttttgctcgtat

SEQ ID NO: 6763 - DNA, 32 bp, Artificial Sequence
  Synthetic polynucleotide
agtctacgcgcgggctgccagtagattgacgc

SEQ ID NO: 6764 - DNA, 32 bp, Artificial Sequence
  Synthetic polynucleotide
accattgtgtcgaatttattgaagaagcgggt

SEQ ID NO: 6765 - DNA, 32 bp, Artificial Sequence
  Synthetic polynucleotide
ttttttttggtgtcaggctgatgctttttttt

SEQ ID NO: 6766 - DNA, 32 bp, Artificial Sequence
  Synthetic polynucleotide
caggcaagagccatttactgaaagatcgccaa

SEQ ID NO: 6767 - DNA, 32 bp, Artificial Sequence
  Synthetic polynucleotide
ttttttttttcaggctggtcagactttttttt

SEQ ID NO: 6768 - DNA, 32 bp, Artificial Sequence
  Synthetic polynucleotide
acttaatacattaagagcactaagtataatag

SEQ ID NO: 6769 - DNA, 32 bp, Artificial Sequence
  Synthetic polynucleotide
tttttttttaattatagaacgatatttttttt

SEQ ID NO: 6770 - DNA, 32 bp, Artificial Sequence
  Synthetic polynucleotide
cttccatgatcacataataccctattgtcgtt

SEQ ID NO: 6771 - DNA, 32 bp, Artificial Sequence
  Synthetic polynucleotide
ttttttttctcggcatcggacggatttttttt

SEQ ID NO: 6772 - DNA, 32 bp, Artificial Sequence
  Synthetic polynucleotide
ggagtcatggtctcgactgtatgaatctatgt

SEQ ID NO: 6773 - DNA, 32 bp, Artificial Sequence
  Synthetic polynucleotide
ttttttttctattgagccaccttatttttttt

SEQ ID NO: 6774 - DNA, 32 bp, Artificial Sequence
  Synthetic polynucleotide
atagaatgttaagtatcctagaactaggcgga

SEQ ID NO: 6775 - DNA, 32 bp, Artificial Sequence
  Synthetic polynucleotide
ttttttttttatgtgattacgccctttttttt

SEQ ID NO: 6776 - DNA, 32 bp, Artificial Sequence
  Synthetic polynucleotide
agtgttttttttttttttttttttttgaccta

SEQ ID NO: 6777 - DNA, 32 bp, Artificial Sequence
  Synthetic polynucleotide
tgggagaatatcaaagagggttcagttcccct

SEQ ID NO: 6778 - DNA, 32 bp, Artificial Sequence
  Synthetic polynucleotide
tgtaccatttttttttttttttttaaaaatca

SEQ ID NO: 6779 - DNA, 32 bp, Artificial Sequence
  Synthetic polynucleotide
taggcaagcgaaggtcaagagcaacaaggcgc

SEQ ID NO: 6780 - DNA, 32 bp, Artificial Sequence
  Synthetic polynucleotide
taggtggtttttttttttttttttcgaacccg

SEQ ID NO: 6781 - DNA, 32 bp, Artificial Sequence
  Synthetic polynucleotide
tggtcggtccggcgaacctaggcgccacgtag

SEQ ID NO: 6782 - DNA, 32 bp, Artificial Sequence
  Synthetic polynucleotide
gatatcgcttttttttttttttttccgtcgat

SEQ ID NO: 6783 - DNA, 32 bp, Artificial Sequence
  Synthetic polynucleotide
ggttcgtgcgtagtgggaattatatcaatttt

SEQ ID NO: 6784 - DNA, 32 bp, Artificial Sequence
  Synthetic polynucleotide
gtaatggtttttttttttttttttacttacct

SEQ ID NO: 6785 - DNA, 32 bp, Artificial Sequence
  Synthetic polynucleotide
acagtgccacattgtacgaccattggtcattg

SEQ ID NO: 6786 - DNA, 32 bp, Artificial Sequence
  Synthetic polynucleotide
aggtcatcttttttttttttttttcgcggaca

SEQ ID NO: 6787 - DNA, 32 bp, Artificial Sequence
  Synthetic polynucleotide
ccatattacctgcttcgtgcgcttatagtgga

SEQ ID NO: 6788 - DNA, 32 bp, Artificial Sequence
  Synthetic polynucleotide
atcatgagactcgccgccagcagttataaaaa

SEQ ID NO: 6789 - DNA, 32 bp, Artificial Sequence
  Synthetic polynucleotide
tttttttttatccattacacagtgtttttttt

SEQ ID NO: 6790 - DNA, 32 bp, Artificial Sequence
  Synthetic polynucleotide
gcccgacgatgctgggatcggattccggcgga

SEQ ID NO: 6791 - DNA, 32 bp, Artificial Sequence
  Synthetic polynucleotide
ttttttttgggcacgactgctttttttttttt

SEQ ID NO: 6792 - DNA, 32 bp, Artificial Sequence
  Synthetic polynucleotide
ggtatttttaagaacagctaagggttttgcat

SEQ ID NO: 6793 - DNA, 32 bp, Artificial Sequence
  Synthetic polynucleotide
tttttttttagcgcctctgctccttttttttt

SEQ ID NO: 6794 - DNA, 32 bp, Artificial Sequence
  Synthetic polynucleotide
cgtcccatcgcattcaccccttcgtttaaaga

SEQ ID NO: 6795 - DNA, 32 bp, Artificial Sequence
  Synthetic polynucleotide
ttttttttgatgcgttagatgcgatttttttt

SEQ ID NO: 6796 - DNA, 32 bp, Artificial Sequence
  Synthetic polynucleotide
gatgatatcgcctccggcgcgggctgactctt

SEQ ID NO: 6797 - DNA, 32 bp, Artificial Sequence
  Synthetic polynucleotide
ttttttttgcgccgtgtggaatactttttttt

SEQ ID NO: 6798 - DNA, 32 bp, Artificial Sequence
  Synthetic polynucleotide
gcatgagaaggctgcgttacacattgacaggt

SEQ ID NO: 6799 - DNA, 32 bp, Artificial Sequence
  Synthetic polynucleotide
ttttttttggtaatccgacccaggtttttttt

SEQ ID NO: 6800 - DNA, 32 bp, Artificial Sequence
  Synthetic polynucleotide
tatcgtccttttttttttttttttctacaact

SEQ ID NO: 6801 - DNA, 32 bp, Artificial Sequence
  Synthetic polynucleotide
caaagggcttggggacaggatggcacctgcca

SEQ ID NO: 6802 - DNA, 32 bp, Artificial Sequence
  Synthetic polynucleotide
acattactttttttttttttttttacactcac

SEQ ID NO: 6803 - DNA, 32 bp, Artificial Sequence
  Synthetic polynucleotide
cataccgtttgttcatgctgtgccatgtgaag

SEQ ID NO: 6804 - DNA, 32 bp, Artificial Sequence
  Synthetic polynucleotide
ctgctgtattttttttttttttttaaactaca

SEQ ID NO: 6805 - DNA, 32 bp, Artificial Sequence
  Synthetic polynucleotide
ctgaatgggtcaagacacctaatgattttata

SEQ ID NO: 6806 - DNA, 32 bp, Artificial Sequence
  Synthetic polynucleotide
agtaacgcttttttttttttttttttacgagt

SEQ ID NO: 6807 - DNA, 32 bp, Artificial Sequence
  Synthetic polynucleotide
gtgccgtagccctaactcgtattaggctccaa

SEQ ID NO: 6808 - DNA, 32 bp, Artificial Sequence
  Synthetic polynucleotide
ggggactcttttttttttttttttagacaatg

SEQ ID NO: 6809 - DNA, 32 bp, Artificial Sequence
  Synthetic polynucleotide
actcgtcgcctcagaataacagcaggtcggcc

SEQ ID NO: 6810 - DNA, 32 bp, Artificial Sequence
  Synthetic polynucleotide
ctggtctcttttttttttttttttccccgctc

SEQ ID NO: 6811 - DNA, 32 bp, Artificial Sequence
  Synthetic polynucleotide
tattgctcacgccctgctgaaggattttttgt

SEQ ID NO: 6812 - DNA, 48 bp, Artificial Sequence
  Synthetic polynucleotide
gtggcgctggcgcagaaaactgagtaagacctgaagaggtgagaacat

SEQ ID NO: 6813 - DNA, 32 bp, Artificial Sequence
  Synthetic polynucleotide
ttttttttgtgaaccccgtcctgttttttttt

SEQ ID NO: 6814 - DNA, 48 bp, Artificial Sequence
  Synthetic polynucleotide
cactccaaggcactagacttggacaaagtgagcatacacaccacaatg

SEQ ID NO: 6815 - DNA, 32 bp, Artificial Sequence
  Synthetic polynucleotide
ttttttttcttctttccgtgacggtttttttt

SEQ ID NO: 6816 - DNA, 48 bp, Artificial Sequence
  Synthetic polynucleotide
tttacgctgcgtagctatcccggatcttgtattccctaaatgtccgtg

SEQ ID NO: 6817 - DNA, 32 bp, Artificial Sequence
  Synthetic polynucleotide
ttttttttcctgtgaaatattgcttttttttt

SEQ ID NO: 6818 - DNA, 48 bp, Artificial Sequence
  Synthetic polynucleotide
acgggacaagcgggtctgctcaatatgtgtacgatagagaactgtccc

SEQ ID NO: 6819 - DNA, 32 bp, Artificial Sequence
  Synthetic polynucleotide
ttttttttaggcctcggttagtggtttttttt

SEQ ID NO: 6820 - DNA, 48 bp, Artificial Sequence
  Synthetic polynucleotide
agacatagtattcttctttgcaccacctatacttaaccataaggtccg

SEQ ID NO: 6821 - DNA, 32 bp, Artificial Sequence
  Synthetic polynucleotide
ttttttttatgccgttaatattgctttttttt

SEQ ID NO: 6822 - DNA, 48 bp, Artificial Sequence
  Synthetic polynucleotide
cttacttgccggacgcgagccgatggagtgttaattatcacatgttgt

SEQ ID NO: 6823 - DNA, 32 bp, Artificial Sequence
  Synthetic polynucleotide
tttttttttcaatttccttggacatttttttt

SEQ ID NO: 6824 - DNA, 48 bp, Artificial Sequence
  Synthetic polynucleotide
ctccgcattgcagggtaactcatattttttttttttttttgcgcccac

SEQ ID NO: 6825 - DNA, 48 bp, Artificial Sequence
  Synthetic polynucleotide
ttttttttcactttaagcgacgctgcctacctgtcggaagaaacgtcc

SEQ ID NO: 6826 - DNA, 48 bp, Artificial Sequence
  Synthetic polynucleotide
taacaaggggtgcgtcgctcattcttttttttttttttttttagggtc

SEQ ID NO: 6827 - DNA, 48 bp, Artificial Sequence
  Synthetic polynucleotide
ttttttttcccggtcaactgtagttgccatcggaatatccccggttga

SEQ ID NO: 6828 - DNA, 48 bp, Artificial Sequence
  Synthetic polynucleotide
agccagagtgatcaatcggcgccgtttttttttttttttttttgtacg

SEQ ID NO: 6829 - DNA, 48 bp, Artificial Sequence
  Synthetic polynucleotide
ttttttttggaacagacccggtggcttggtaattacctgcgacccaaa

SEQ ID NO: 6830 - DNA, 48 bp, Artificial Sequence
  Synthetic polynucleotide
ctgctgaacccgcggtgaaggctgttttttttttttttttgactcgag

SEQ ID NO: 6831 - DNA, 48 bp, Artificial Sequence
  Synthetic polynucleotide
ttttttttcatcgtgcatgttccggagtaaggcgtgggacattccacg

SEQ ID NO: 6832 - DNA, 48 bp, Artificial Sequence
  Synthetic polynucleotide
gcgccagacacgtaaaggttgcggtttttttttttttttttaggttat

SEQ ID NO: 6833 - DNA, 48 bp, Artificial Sequence
  Synthetic polynucleotide
tttttttttgacacccgttgttccctaagccgtcacataccagctgga

SEQ ID NO: 6834 - DNA, 48 bp, Artificial Sequence
  Synthetic polynucleotide
gccaaaatcgggcatcaaatacgattttttttttttttttgcccacca

SEQ ID NO: 6835 - DNA, 48 bp, Artificial Sequence
  Synthetic polynucleotide
ttttttttaaaacgacgcggcgaacccgttcccccgacaaggcagcag

SEQ ID NO: 6836 - DNA, 16 bp, Artificial Sequence
  Synthetic polynucleotide
tttttttttacgtctt

SEQ ID NO: 6837 - DNA, 16 bp, Artificial Sequence
  Synthetic polynucleotide
ttttttttttgcgctt

SEQ ID NO: 6838 - DNA, 16 bp, Artificial Sequence
  Synthetic polynucleotide
ttttttttagtattcc

SEQ ID NO: 6839 - DNA, 16 bp, Artificial Sequence
  Synthetic polynucleotide
tttttttttggcaccc

SEQ ID NO: 6840 - DNA, 16 bp, Artificial Sequence
  Synthetic polynucleotide
ttttttttttgccctt

SEQ ID NO: 6841 - DNA, 16 bp, Artificial Sequence
  Synthetic polynucleotide
tttttttttgaatctt

SEQ ID NO: 6842 - DNA, 32 bp, Artificial Sequence; identical to SEQ ID NO: 3
  Synthetic polynucleotide

SEQ ID NO: 6843 - DNA, 32 bp, Artificial Sequence; identical to SEQ ID NO: 4
  Synthetic polynucleotide

SEQ ID NO: 6844 - DNA, 32 bp, Artificial Sequence; identical to SEQ ID NO: 5
  Synthetic polynucleotide

SEQ ID NO: 6845 - DNA, 32 bp, Artificial Sequence; identical to SEQ ID NO: 6
  Synthetic polynucleotide

SEQ ID NO: 6846 - DNA, 32 bp, Artificial Sequence; identical to SEQ ID NO: 7
  Synthetic polynucleotide

SEQ ID NO: 6847 - DNA, 32 bp, Artificial Sequence; identical to SEQ ID NO: 8
  Synthetic polynucleotide

SEQ ID NO: 6848 - DNA, 32 bp, Artificial Sequence; identical to SEQ ID NO: 9
  Synthetic polynucleotide

SEQ ID NO: 6849 - DNA, 32 bp, Artificial Sequence; identical to SEQ ID NO: 10
  Synthetic polynucleotide

SEQ ID NO: 6850 - DNA, 32 bp, Artificial Sequence; identical to SEQ ID NO: 11
  Synthetic polynucleotide

SEQ ID NO: 6851 - DNA, 32 bp, Artificial Sequence; identical to SEQ ID NO: 1901
  Synthetic polynucleotide

SEQ ID NO: 6852 - DNA, 32 bp, Artificial Sequence; identical to SEQ ID NO: 1902
  Synthetic polynucleotide

SEQ ID NO: 6853 - DNA, 32 bp, Artificial Sequence; identical to SEQ ID NO: 348
  Synthetic polynucleotide

SEQ ID NO: 6854 - DNA, 32 bp, Artificial Sequence; identical to SEQ ID NO: 17
  Synthetic polynucleotide

SEQ ID NO: 6855 - DNA, 32 bp, Artificial Sequence; identical to SEQ ID NO: 18
  Synthetic polynucleotide

SEQ ID NO: 6856 - DNA, 32 bp, Artificial Sequence; identical to SEQ ID NO: 19
  Synthetic polynucleotide

SEQ ID NO: 6857 - DNA, 32 bp, Artificial Sequence; identical to SEQ ID NO: 20
  Synthetic polynucleotide

SEQ ID NO: 6858 - DNA, 32 bp, Artificial Sequence; identical to SEQ ID NO: 21
  Synthetic polynucleotide

SEQ ID NO: 6859 - DNA, 32 bp, Artificial Sequence; identical to SEQ ID NO: 22
  Synthetic polynucleotide

SEQ ID NO: 6860 - DNA, 32 bp, Artificial Sequence; identical to SEQ ID NO: 23
  Synthetic polynucleotide

SEQ ID NO: 6861 - DNA, 32 bp, Artificial Sequence; identical to SEQ ID NO: 24
  Synthetic polynucleotide

SEQ ID NO: 6862 - DNA, 32 bp, Artificial Sequence; identical to SEQ ID NO: 3319
  Synthetic polynucleotide

SEQ ID NO: 6863 - DNA, 32 bp, Artificial Sequence; identical to SEQ ID NO: 355
  Synthetic polynucleotide

SEQ ID NO: 6864 - DNA, 32 bp, Artificial Sequence; identical to SEQ ID NO: 4534
  Synthetic polynucleotide

SEQ ID NO: 6865 - DNA, 32 bp, Artificial Sequence
  Synthetic polynucleotide
acgactcgtcgaacgaggactgttctacatag

SEQ ID NO: 6866 - DNA, 32 bp, Artificial Sequence
  Synthetic polynucleotide
tgacttggacgaggtttcactgggcgctatac

SEQ ID NO: 6867 - DNA, 32 bp, Artificial Sequence
  Synthetic polynucleotide
aggaaactcgaggggctccctgtctgtcgagc

SEQ ID NO: 6868 - DNA, 32 bp, Artificial Sequence; identical to SEQ ID NO: 1918
  Synthetic polynucleotide

SEQ ID NO: 6869 - DNA, 32 bp, Artificial Sequence
  Synthetic polynucleotide
cagtagttgtgattagcttgggggtgatatac

SEQ ID NO: 6870 - DNA, 32 bp, Artificial Sequence
  Synthetic polynucleotide
ctcactaaactccttctaatgtgactaagcgt

SEQ ID NO: 6871 - DNA, 32 bp, Artificial Sequence
  Synthetic polynucleotide
taactccaaaggaaaccagctatcccatattc

SEQ ID NO: 6872 - DNA, 32 bp, Artificial Sequence; identical to SEQ ID NO: 914
  Synthetic polynucleotide

SEQ ID NO: 6873 - DNA, 32 bp, Artificial Sequence; identical to SEQ ID NO: 41
  Synthetic polynucleotide

SEQ ID NO: 6874 - DNA, 32 bp, Artificial Sequence
  Synthetic polynucleotide
tgagaattgtaaacaggaacagcttagagcag

SEQ ID NO: 6875 - DNA, 32 bp, Artificial Sequence; identical to SEQ ID NO: 156
  Synthetic polynucleotide

SEQ ID NO: 6876 - DNA, 32 bp, Artificial Sequence; identical to SEQ ID NO: 6393
  Synthetic polynucleotide

SEQ ID NO: 6877 - DNA, 32 bp, Artificial Sequence; identical to SEQ ID NO: 918
  Synthetic polynucleotide

SEQ ID NO: 6878 - DNA, 32 bp, Artificial Sequence; identical to SEQ ID NO: 6394
  Synthetic polynucleotide

SEQ ID NO: 6879 - DNA, 32 bp, Artificial Sequence; identical to SEQ ID NO: 6396
  Synthetic polynucleotide

SEQ ID NO: 6880 - DNA, 32 bp, Artificial Sequence; identical to SEQ ID NO: 6395
  Synthetic polynucleotide

SEQ ID NO: 6881 - DNA, 32 bp, Artificial Sequence; identical to SEQ ID NO: 6397
  Synthetic polynucleotide

SEQ ID NO: 6882 - DNA, 32 bp, Artificial Sequence; identical to SEQ ID NO: 6399
  Synthetic polynucleotide

SEQ ID NO: 6883 - DNA, 32 bp, Artificial Sequence; identical to SEQ ID NO: 6398
  Synthetic polynucleotide

SEQ ID NO: 6884 - DNA, 32 bp, Artificial Sequence; identical to SEQ ID NO: 54
  Synthetic polynucleotide

SEQ ID NO: 6885 - DNA, 32 bp, Artificial Sequence; identical to SEQ ID NO: 56
  Synthetic polynucleotide

SEQ ID NO: 6886 - DNA, 32 bp, Artificial Sequence; identical to SEQ ID NO: 6403
  Synthetic polynucleotide

SEQ ID NO: 6887 - DNA, 32 bp, Artificial Sequence; identical to SEQ ID NO: 61
  Synthetic polynucleotide

SEQ ID NO: 6888 - DNA, 32 bp, Artificial Sequence; identical to SEQ ID NO: 62
  Synthetic polynucleotide

SEQ ID NO: 6889 - DNA, 32 bp, Artificial Sequence; identical to SEQ ID NO: 63
  Synthetic polynucleotide

SEQ ID NO: 6890 - DNA, 32 bp, Artificial Sequence; identical to SEQ ID NO: 64
  Synthetic polynucleotide

SEQ ID NO: 6891 - DNA, 32 bp, Artificial Sequence; identical to SEQ ID NO: 65
  Synthetic polynucleotide

SEQ ID NO: 6892 - DNA, 32 bp, Artificial Sequence; identical to SEQ ID NO: 66
  Synthetic polynucleotide

SEQ ID NO: 6893 - DNA, 32 bp, Artificial Sequence; identical to SEQ ID NO: 67
  Synthetic polynucleotide

SEQ ID NO: 6894 - DNA, 32 bp, Artificial Sequence; identical to SEQ ID NO: 1943
  Synthetic polynucleotide

SEQ ID NO: 6895 - DNA, 32 bp, Artificial Sequence; identical to SEQ ID NO: 936
  Synthetic polynucleotide

SEQ ID NO: 6896 - DNA, 32 bp, Artificial Sequence; identical to SEQ ID NO: 392
  Synthetic polynucleotide

SEQ ID NO: 6897 - DNA, 32 bp, Artificial Sequence; identical to SEQ ID NO: 73
  Synthetic polynucleotide

SEQ ID NO: 6898 - DNA, 32 bp, Artificial Sequence; identical to SEQ ID NO: 74
  Synthetic polynucleotide

SEQ ID NO: 6899 - DNA, 32 bp, Artificial Sequence; identical to SEQ ID NO: 75
  Synthetic polynucleotide

SEQ ID NO: 6900 - DNA, 32 bp, Artificial Sequence; identical to SEQ ID NO: 76
  Synthetic polynucleotide

SEQ ID NO: 6901 - DNA, 32 bp, Artificial Sequence; identical to SEQ ID NO: 77
  Synthetic polynucleotide

SEQ ID NO: 6902 - DNA, 32 bp, Artificial Sequence; identical to SEQ ID NO: 78
  Synthetic polynucleotide

SEQ ID NO: 6903 - DNA, 32 bp, Artificial Sequence; identical to SEQ ID NO: 157
  Synthetic polynucleotide

SEQ ID NO: 6904 - DNA, 32 bp, Artificial Sequence; identical to SEQ ID NO: 158
  Synthetic polynucleotide

SEQ ID NO: 6905 - DNA, 32 bp, Artificial Sequence; identical to SEQ ID NO: 4377
  Synthetic polynucleotide

SEQ ID NO: 6906 - DNA, 32 bp, Artificial Sequence; identical to SEQ ID NO: 4432
  Synthetic polynucleotide

SEQ ID NO: 6907 - DNA, 32 bp, Artificial Sequence; identical to SEQ ID NO: 162
  Synthetic polynucleotide

SEQ ID NO: 6908 - DNA, 32 bp, Artificial Sequence; identical to SEQ ID NO: 1956
  Synthetic polynucleotide

SEQ ID NO: 6909 - DNA, 32 bp, Artificial Sequence; identical to SEQ ID NO: 4640
  Synthetic polynucleotide

SEQ ID NO: 6910 - DNA, 32 bp, Artificial Sequence; identical to SEQ ID NO: 6431
  Synthetic polynucleotide

SEQ ID NO: 6911 - DNA, 32 bp, Artificial Sequence; identical to SEQ ID NO: 1960
  Synthetic polynucleotide

SEQ ID NO: 6912 - DNA, 32 bp, Artificial Sequence; identical to SEQ ID NO: 6432
  Synthetic polynucleotide

SEQ ID NO: 6913 - DNA, 32 bp, Artificial Sequence; identical to SEQ ID NO: 6434
  Synthetic polynucleotide

SEQ ID NO: 6914 - DNA, 32 bp, Artificial Sequence; identical to SEQ ID NO: 6433
  Synthetic polynucleotide

SEQ ID NO: 6915 - DNA, 32 bp, Artificial Sequence; identical to SEQ ID NO: 6435
  Synthetic polynucleotide

SEQ ID NO: 6916 - DNA, 32 bp, Artificial Sequence; identical to SEQ ID NO: 6437
  Synthetic polynucleotide

SEQ ID NO: 6917 - DNA, 32 bp, Artificial Sequence; identical to SEQ ID NO: 6436
  Synthetic polynucleotide

SEQ ID NO: 6918 - DNA, 32 bp, Artificial Sequence; identical to SEQ ID NO: 4711
  Synthetic polynucleotide

SEQ ID NO: 6919 - DNA, 32 bp, Artificial Sequence; identical to SEQ ID NO: 6440
  Synthetic polynucleotide

SEQ ID NO: 6920 - DNA, 32 bp, Artificial Sequence; identical to SEQ ID NO: 6439
  Synthetic polynucleotide

SEQ ID NO: 6921 - DNA, 32 bp, Artificial Sequence
  Synthetic polynucleotide
cgaacgagatcgtcctagacgacggatctcct

SEQ ID NO: 6922 - DNA, 32 bp, Artificial Sequence
  Synthetic polynucleotide
gcatgccggtagcaccgtcaaatatgcgtgct

SEQ ID NO: 6923 - DNA, 32 bp, Artificial Sequence
  Synthetic polynucleotide
tttaacgctttagacccagcttgacgcaagac

SEQ ID NO: 6924 - DNA, 32 bp, Artificial Sequence; identical to SEQ ID NO: 6445
  Synthetic polynucleotide

SEQ ID NO: 6925 - DNA, 32 bp, Artificial Sequence
  Synthetic polynucleotide
aacctaccccctaagcagcgtagtaagggtta

SEQ ID NO: 6926 - DNA, 32 bp, Artificial Sequence
  Synthetic polynucleotide
caagttcctgcggcggctgtacgaatgagtcc

SEQ ID NO: 6927 - DNA, 32 bp, Artificial Sequence; identical to SEQ ID NO: 966
  Synthetic polynucleotide

SEQ ID NO: 6928 - DNA, 32 bp, Artificial Sequence; identical to SEQ ID NO: 421
  Synthetic polynucleotide

SEQ ID NO: 6929 - DNA, 32 bp, Artificial Sequence
  Synthetic polynucleotide
gtagtacagtatcttttttcatggcggcgatg

SEQ ID NO: 6930 - DNA, 32 bp, Artificial Sequence; identical to SEQ ID NO: 6451
  Synthetic polynucleotide

SEQ ID NO: 6931 - DNA, 32 bp, Artificial Sequence; identical to SEQ ID NO: 970
  Synthetic polynucleotide

SEQ ID NO: 6932 - DNA, 32 bp, Artificial Sequence; identical to SEQ ID NO: 429
  Synthetic polynucleotide

SEQ ID NO: 6933 - DNA, 32 bp, Artificial Sequence; identical to SEQ ID NO: 431
  Synthetic polynucleotide

SEQ ID NO: 6934 - DNA, 32 bp, Artificial Sequence; identical to SEQ ID NO: 430
  Synthetic polynucleotide

SEQ ID NO: 6935 - DNA, 32 bp, Artificial Sequence; identical to SEQ ID NO: 432
  Synthetic polynucleotide

SEQ ID NO: 6936 - DNA, 32 bp, Artificial Sequence; identical to SEQ ID NO: 1984
  Synthetic polynucleotide

SEQ ID NO: 6937 - DNA, 32 bp, Artificial Sequence; identical to SEQ ID NO: 1985
  Synthetic polynucleotide

SEQ ID NO: 6938 - DNA, 32 bp, Artificial Sequence; identical to SEQ ID NO: 1986
  Synthetic polynucleotide

SEQ ID NO: 6939 - DNA, 32 bp, Artificial Sequence; identical to SEQ ID NO: 436
  Synthetic polynucleotide

SEQ ID NO: 6940 - DNA, 32 bp, Artificial Sequence; identical to SEQ ID NO: 1988
  Synthetic polynucleotide

SEQ ID NO: 6941 - DNA, 32 bp, Artificial Sequence; identical to SEQ ID NO: 1989
  Synthetic polynucleotide

SEQ ID NO: 6942 - DNA, 32 bp, Artificial Sequence; identical to SEQ ID NO: 440
  Synthetic polynucleotide

SEQ ID NO: 6943 - DNA, 32 bp, Artificial Sequence; identical to SEQ ID NO: 438
  Synthetic polynucleotide

SEQ ID NO: 6944 - DNA, 32 bp, Artificial Sequence; identical to SEQ ID NO: 441
  Synthetic polynucleotide

SEQ ID NO: 6945 - DNA, 32 bp, Artificial Sequence; identical to SEQ ID NO: 439
  Synthetic polynucleotide

SEQ ID NO: 6946 - DNA, 32 bp, Artificial Sequence; identical to SEQ ID NO: 444
  Synthetic polynucleotide

SEQ ID NO: 6947 - DNA, 32 bp, Artificial Sequence; identical to SEQ ID NO: 442
  Synthetic polynucleotide

SEQ ID NO: 6948 - DNA, 32 bp, Artificial Sequence; identical to SEQ ID NO: 4379
  Synthetic polynucleotide

SEQ ID NO: 6949 - DNA, 32 bp, Artificial Sequence; identical to SEQ ID NO: 4145
  Synthetic polynucleotide

SEQ ID NO: 6950 - DNA, 32 bp, Artificial Sequence; identical to SEQ ID NO: 988
  Synthetic polynucleotide

SEQ ID NO: 6951 - DNA, 32 bp, Artificial Sequence; identical to SEQ ID NO: 4537
  Synthetic polynucleotide

SEQ ID NO: 6952 - DNA, 32 bp, Artificial Sequence; identical to SEQ ID NO: 990
  Synthetic polynucleotide

SEQ ID NO: 6953 - DNA, 32 bp, Artificial Sequence; identical to SEQ ID NO: 6474
  Synthetic polynucleotide

SEQ ID NO: 6954 - DNA, 32 bp, Artificial Sequence
  Synthetic polynucleotide
acgctctgttccaaactttagagcccggccgt

SEQ ID NO: 6955 - DNA, 32 bp, Artificial Sequence; identical to SEQ ID NO: 6480
  Synthetic polynucleotide

SEQ ID NO: 6956 - DNA, 32 bp, Artificial Sequence
  Synthetic polynucleotide
ctactggcgttttcatatatcagagagcacag

SEQ ID NO: 6957 - DNA, 32 bp, Artificial Sequence; identical to SEQ ID NO: 996
  Synthetic polynucleotide

SEQ ID NO: 6958 - DNA, 32 bp, Artificial Sequence
  Synthetic polynucleotide
tcatatggacacaccagattacggcggcttag

SEQ ID NO: 6959 - DNA, 32 bp, Artificial Sequence
  Synthetic polynucleotide
gggaattgagtacaagtgacgaagaataccgt

SEQ ID NO: 6960 - DNA, 32 bp, Artificial Sequence
  Synthetic polynucleotide
ccatcagatggagctgtcaggcttctccgtca

SEQ ID NO: 6961 - DNA, 32 bp, Artificial Sequence
  Synthetic polynucleotide
aaatgttggctgagattgattggtttagtgta

SEQ ID NO: 6962 - DNA, 32 bp, Artificial Sequence
  Synthetic polynucleotide
tagcgagtaagagatatgtgggaggatcatta

SEQ ID NO: 6963 - DNA, 32 bp, Artificial Sequence
  Synthetic polynucleotide
caggatcaaagttgactagcagaataatttgc

SEQ ID NO: 6964 - DNA, 32 bp, Artificial Sequence
  Synthetic polynucleotide
atccgaataaggtacgcaattactatttgtac

SEQ ID NO: 6965 - DNA, 32 bp, Artificial Sequence
  Synthetic polynucleotide
cgaaaacaagggcatacagtaacgaaaagcga

SEQ ID NO: 6966 - DNA, 32 bp, Artificial Sequence
  Synthetic polynucleotide
acgagccaccacctagcacctcctgttagggt

SEQ ID NO: 6967 - DNA, 32 bp, Artificial Sequence
  Synthetic polynucleotide
gacacccgggatgggttgttcatcggtcaccc

SEQ ID NO: 6968 - DNA, 32 bp, Artificial Sequence
  Synthetic polynucleotide
cagttttcgcttgaggaatagtccaagaaatg

SEQ ID NO: 6969 - DNA, 32 bp, Artificial Sequence
  Synthetic polynucleotide
catgataaaagttgtgccgcactggaatctga

SEQ ID NO: 6970 - DNA, 32 bp, Artificial Sequence
  Synthetic polynucleotide
agatgcaccggttctcgagacactcatttact

SEQ ID NO: 6971 - DNA, 32 bp, Artificial Sequence
  Synthetic polynucleotide
gctcggtagaccatgtctccagtattgccatt

SEQ ID NO: 6972 - DNA, 32 bp, Artificial Sequence
  Synthetic polynucleotide
ttctaattaatacttttaatataatgtccgcg

SEQ ID NO: 6973 - DNA, 32 bp, Artificial Sequence
  Synthetic polynucleotide
gatcagcgaattcgacacaatggtatcttttg

SEQ ID NO: 6974 - DNA, 32 bp, Artificial Sequence; identical to SEQ ID NO: 2020
  Synthetic polynucleotide

SEQ ID NO: 6975 - DNA, 32 bp, Artificial Sequence; identical to SEQ ID NO: 3649
  Synthetic polynucleotide

SEQ ID NO: 6976 - DNA, 32 bp, Artificial Sequence; identical to SEQ ID NO: 6501
  Synthetic polynucleotide

SEQ ID NO: 6977 - DNA, 32 bp, Artificial Sequence; identical to SEQ ID NO: 1016
  Synthetic polynucleotide

SEQ ID NO: 6978 - DNA, 32 bp, Artificial Sequence; identical to SEQ ID NO: 3355
  Synthetic polynucleotide

SEQ ID NO: 6979 - DNA, 32 bp, Artificial Sequence; identical to SEQ ID NO: 2026
  Synthetic polynucleotide

SEQ ID NO: 6980 - DNA, 32 bp, Artificial Sequence; identical to SEQ ID NO: 2027
  Synthetic polynucleotide

SEQ ID NO: 6981 - DNA, 32 bp, Artificial Sequence; identical to SEQ ID NO: 2028
  Synthetic polynucleotide

SEQ ID NO: 6982 - DNA, 32 bp, Artificial Sequence; identical to SEQ ID NO: 1020
  Synthetic polynucleotide

SEQ ID NO: 6983 - DNA, 32 bp, Artificial Sequence; identical to SEQ ID NO: 2030
  Synthetic polynucleotide

SEQ ID NO: 6984 - DNA, 32 bp, Artificial Sequence; identical to SEQ ID NO: 2031
  Synthetic polynucleotide

SEQ ID NO: 6985 - DNA, 32 bp, Artificial Sequence; identical to SEQ ID NO: 2032
  Synthetic polynucleotide

SEQ ID NO: 6986 - DNA, 32 bp, Artificial Sequence; identical to SEQ ID NO: 2033
  Synthetic polynucleotide

SEQ ID NO: 6987 - DNA, 32 bp, Artificial Sequence; identical to SEQ ID NO: 2034
  Synthetic polynucleotide

SEQ ID NO: 6988 - DNA, 32 bp, Artificial Sequence; identical to SEQ ID NO: 3475
  Synthetic polynucleotide

SEQ ID NO: 6989 - DNA, 32 bp, Artificial Sequence
  Synthetic polynucleotide
atggtacacccagcattccttcagtccgccta

SEQ ID NO: 6990 - DNA, 32 bp, Artificial Sequence; identical to SEQ ID NO: 3499
  Synthetic polynucleotide

SEQ ID NO: 6991 - DNA, 32 bp, Artificial Sequence; identical to SEQ ID NO: 4380
  Synthetic polynucleotide

SEQ ID NO: 6992 - DNA, 32 bp, Artificial Sequence; identical to SEQ ID NO: 3523
  Synthetic polynucleotide

SEQ ID NO: 6993 - DNA, 32 bp, Artificial Sequence; identical to SEQ ID NO: 4484
  Synthetic polynucleotide

SEQ ID NO: 6994 - DNA, 32 bp, Artificial Sequence; identical to SEQ ID NO: 3547
  Synthetic polynucleotide

SEQ ID NO: 6995 - DNA, 32 bp, Artificial Sequence; identical to SEQ ID NO: 4591
  Synthetic polynucleotide

SEQ ID NO: 6996 - DNA, 32 bp, Artificial Sequence; identical to SEQ ID NO: 3571
  Synthetic polynucleotide

SEQ ID NO: 6997 - DNA, 32 bp, Artificial Sequence; identical to SEQ ID NO: 2042
  Synthetic polynucleotide

SEQ ID NO: 6998 - DNA, 32 bp, Artificial Sequence
  Synthetic polynucleotide
accattaccggaggcgcattaggtctattata

SEQ ID NO: 6999 - DNA, 32 bp, Artificial Sequence; identical to SEQ ID NO: 3619
  Synthetic polynucleotide

SEQ ID NO: 7000 - DNA, 32 bp, Artificial Sequence
  Synthetic polynucleotide
atatcatctacaatgtgtctgacccttcacat

SEQ ID NO: 7001 - DNA, 32 bp, Artificial Sequence
  Synthetic polynucleotide
taatatggggattacccttcaataagttgtag

SEQ ID NO: 7002 - DNA, 32 bp, Artificial Sequence
  Synthetic polynucleotide
gcatcagctggcaggtgccatcctacccgctt

SEQ ID NO: 7003 - DNA, 32 bp, Artificial Sequence
  Synthetic polynucleotide
tctcatgcgaagcaggatgtgtaatggtgggc

SEQ ID NO: 7004 - DNA, 32 bp, Artificial Sequence; identical to SEQ ID NO: 4713
  Synthetic polynucleotide

SEQ ID NO: 7005 - DNA, 32 bp, Artificial Sequence; identical to SEQ ID NO: 6533
  Synthetic polynucleotide

SEQ ID NO: 7006 - DNA, 32 bp, Artificial Sequence; identical to SEQ ID NO: 6532
  Synthetic polynucleotide

SEQ ID NO: 7007 - DNA, 32 bp, Artificial Sequence; identical to SEQ ID NO: 5831
  Synthetic polynucleotide

SEQ ID NO: 7008 - DNA, 32 bp, Artificial Sequence; identical to SEQ ID NO: 6536
  Synthetic polynucleotide

SEQ ID NO: 7009 - DNA, 32 bp, Artificial Sequence; identical to SEQ ID NO: 6535
  Synthetic polynucleotide

SEQ ID NO: 7010 - DNA, 32 bp, Artificial Sequence; identical to SEQ ID NO: 6537
  Synthetic polynucleotide

SEQ ID NO: 7011 - DNA, 32 bp, Artificial Sequence; identical to SEQ ID NO: 6539
  Synthetic polynucleotide

SEQ ID NO: 7012 - DNA, 32 bp, Artificial Sequence; identical to SEQ ID NO: 5835
  Synthetic polynucleotide

SEQ ID NO: 7013 - DNA, 32 bp, Artificial Sequence; identical to SEQ ID NO: 6540
  Synthetic polynucleotide

SEQ ID NO: 7014 - DNA, 32 bp, Artificial Sequence; identical to SEQ ID NO: 6542
  Synthetic polynucleotide

SEQ ID NO: 7015 - DNA, 32 bp, Artificial Sequence; identical to SEQ ID NO: 6541
  Synthetic polynucleotide

SEQ ID NO: 7016 - DNA, 32 bp, Artificial Sequence; identical to SEQ ID NO: 6543
  Synthetic polynucleotide

SEQ ID NO: 7017 - DNA, 32 bp, Artificial Sequence; identical to SEQ ID NO: 2062
  Synthetic polynucleotide

SEQ ID NO: 7018 - DNA, 32 bp, Artificial Sequence; identical to SEQ ID NO: 6544
  Synthetic polynucleotide

SEQ ID NO: 7019 - DNA, 32 bp, Artificial Sequence
  Synthetic polynucleotide
cttccgactttttataactgctgggtgggcgc

SEQ ID NO: 7020 - DNA, 32 bp, Artificial Sequence; identical to SEQ ID NO: 4381
  Synthetic polynucleotide

SEQ ID NO: 7021 - DNA, 32 bp, Artificial Sequence; identical to SEQ ID NO: 2066
  Synthetic polynucleotide

SEQ ID NO: 7022 - DNA, 32 bp, Artificial Sequence; identical to SEQ ID NO: 2068
  Synthetic polynucleotide

SEQ ID NO: 7023 - DNA, 32 bp, Artificial Sequence; identical to SEQ ID NO: 2069
  Synthetic polynucleotide

SEQ ID NO: 7024 - DNA, 32 bp, Artificial Sequence; identical to SEQ ID NO: 2070
  Synthetic polynucleotide

SEQ ID NO: 7025 - DNA, 32 bp, Artificial Sequence; identical to SEQ ID NO: 2071
  Synthetic polynucleotide

SEQ ID NO: 7026 - DNA, 32 bp, Artificial Sequence; identical to SEQ ID NO: 2072
  Synthetic polynucleotide

SEQ ID NO: 7027 - DNA, 32 bp, Artificial Sequence; identical to SEQ ID NO: 2073
  Synthetic polynucleotide

SEQ ID NO: 7028 - DNA, 32 bp, Artificial Sequence; identical to SEQ ID NO: 2074
  Synthetic polynucleotide

SEQ ID NO: 7029 - DNA, 32 bp, Artificial Sequence; identical to SEQ ID NO: 2075
  Synthetic polynucleotide

SEQ ID NO: 7030 - DNA, 32 bp, Artificial Sequence; identical to SEQ ID NO: 2076
  Synthetic polynucleotide

SEQ ID NO: 7031 - DNA, 32 bp, Artificial Sequence; identical to SEQ ID NO: 3650
  Synthetic polynucleotide

SEQ ID NO: 7032 - DNA, 32 bp, Artificial Sequence; identical to SEQ ID NO: 4057
  Synthetic polynucleotide

SEQ ID NO: 7033 - DNA, 32 bp, Artificial Sequence; identical to SEQ ID NO: 4337
  Synthetic polynucleotide

SEQ ID NO: 7034 - DNA, 32 bp, Artificial Sequence; identical to SEQ ID NO: 3664
  Synthetic polynucleotide

SEQ ID NO: 7035 - DNA, 32 bp, Artificial Sequence; identical to SEQ ID NO: 4436
  Synthetic polynucleotide

SEQ ID NO: 7036 - DNA, 32 bp, Artificial Sequence; identical to SEQ ID NO: 4174
  Synthetic polynucleotide

SEQ ID NO: 7037 - DNA, 32 bp, Artificial Sequence; identical to SEQ ID NO: 4540
  Synthetic polynucleotide

SEQ ID NO: 7038 - DNA, 32 bp, Artificial Sequence; identical to SEQ ID NO: 4593
  Synthetic polynucleotide

SEQ ID NO: 7039 - DNA, 32 bp, Artificial Sequence; identical to SEQ ID NO: 4644
  Synthetic polynucleotide

SEQ ID NO: 7040 - DNA, 32 bp, Artificial Sequence; identical to SEQ ID NO: 2084
  Synthetic polynucleotide

SEQ ID NO: 7041 - DNA, 32 bp, Artificial Sequence
  Synthetic polynucleotide
tcatcgtaggacatcacatctctgcctcgacg

SEQ ID NO: 7042 - DNA, 32 bp, Artificial Sequence
  Synthetic polynucleotide
tacgcgggcaatggaggtgggcgcaaaccgtt

SEQ ID NO: 7043 - DNA, 32 bp, Artificial Sequence
  Synthetic polynucleotide
ttcaacttttaaacagttgaaggtttgaacca

SEQ ID NO: 7044 - DNA, 32 bp, Artificial Sequence; identical to SEQ ID NO: 2088
  Synthetic polynucleotide

SEQ ID NO: 7045 - DNA, 32 bp, Artificial Sequence
  Synthetic polynucleotide
atcacgctctacagcaccgtgatgagacttcg

SEQ ID NO: 7046 - DNA, 32 bp, Artificial Sequence
  Synthetic polynucleotide
tgcgttcgacgcctgcttccgtggccccgcaa

SEQ ID NO: 7047 - DNA, 32 bp, Artificial Sequence
  Synthetic polynucleotide
ccgcatcgctgagggggaggggatagcatacc

SEQ ID NO: 7048 - DNA, 32 bp, Artificial Sequence
  Synthetic polynucleotide
cagcacaaaccctcgcgggtgatcggccgtta

SEQ ID NO: 7049 - DNA, 32 bp, Artificial Sequence
  Synthetic polynucleotide
gtcgtaatgtgctgtgttctatcgatctcctt

SEQ ID NO: 7050 - DNA, 32 bp, Artificial Sequence
  Synthetic polynucleotide
cgcaacaaaatgcaaaaccatgttgaaattgt

SEQ ID NO: 7051 - DNA, 32 bp, Artificial Sequence
  Synthetic polynucleotide
gctgccgacacgaggcacacggcgtcagcgat

SEQ ID NO: 7052 - DNA, 32 bp, Artificial Sequence
  Synthetic polynucleotide
cgcatctacctagcaataagacaagtagaaca

SEQ ID NO: 7053 - DNA, 32 bp, Artificial Sequence
  Synthetic polynucleotide
ttgtgttgggtgtagtggattcatttaactac

SEQ ID NO: 7054 - DNA, 32 bp, Artificial Sequence
  Synthetic polynucleotide
cgatgttattacctaataccatgaggagcagg

SEQ ID NO: 7055 - DNA, 32 bp, Artificial Sequence
  Synthetic polynucleotide
gattgactaatacatttatgaatccagacacg

SEQ ID NO: 7056 - DNA, 32 bp, Artificial Sequence
  Synthetic polynucleotide
aggtacactccggggagtagtctgtagggtga

SEQ ID NO: 7057 - DNA, 32 bp, Artificial Sequence
  Synthetic polynucleotide
tatacccggcaagctcgtcaagtggtatagcc

SEQ ID NO: 7058 - DNA, 32 bp, Artificial Sequence
  Synthetic polynucleotide
cgcagcactacgctccaaatactgcccacggt

SEQ ID NO: 7059 - DNA, 32 bp, Artificial Sequence
  Synthetic polynucleotide
attaggcactccataaaggcgtctcaggaagt

SEQ ID NO: 7060 - DNA, 32 bp, Artificial Sequence
  Synthetic polynucleotide
gttttgtgctcgacaataccctccctctgcgg

SEQ ID NO: 7061 - DNA, 32 bp, Artificial Sequence
  Synthetic polynucleotide
cgcgaccacattggcactataagactactcca

SEQ ID NO: 7062 - DNA, 32 bp, Artificial Sequence; identical to SEQ ID NO: 5883
  Synthetic polynucleotide

SEQ ID NO: 7063 - DNA, 32 bp, Artificial Sequence; identical to SEQ ID NO: 5489
  Synthetic polynucleotide

SEQ ID NO: 7064 - DNA, 32 bp, Artificial Sequence
  Synthetic polynucleotide
ggtatgcattggctcaaaacgtctagtatttc

SEQ ID NO: 7065 - DNA, 32 bp, Artificial Sequence; identical to SEQ ID NO: 4175
  Synthetic polynucleotide

SEQ ID NO: 7066 - DNA, 32 bp, Artificial Sequence; identical to SEQ ID NO: 5887
  Synthetic polynucleotide

SEQ ID NO: 7067 - DNA, 32 bp, Artificial Sequence
  Synthetic polynucleotide
taacctggccatccctcgagggtttgtttcac

SEQ ID NO: 7068 - DNA, 32 bp, Artificial Sequence
  Synthetic polynucleotide
gtatgatttccggtttgggcactcgtataacc

SEQ ID NO: 7069 - DNA, 32 bp, Artificial Sequence
  Synthetic polynucleotide
ttttttttaagtgtgtagctatggtttttttt

SEQ ID NO: 7070 - DNA, 32 bp, Artificial Sequence
  Synthetic polynucleotide
acccgagcgcggccatgttatttctatttcga

SEQ ID NO: 7071 - DNA, 32 bp, Artificial Sequence
  Synthetic polynucleotide
cactgagtcgctcagccggaacagccaaggca

SEQ ID NO: 7072 - DNA, 32 bp, Artificial Sequence
  Synthetic polynucleotide
ttttttttcagtctctgcggaacctttttttt

SEQ ID NO: 7073 - DNA, 32 bp, Artificial Sequence
  Synthetic polynucleotide
acaggcggacagctaagaacttgaatcatggt

SEQ ID NO: 7074 - DNA, 32 bp, Artificial Sequence
  Synthetic polynucleotide
tcagaaacttccagcttgacgatccgcagggt

SEQ ID NO: 7075 - DNA, 32 bp, Artificial Sequence
  Synthetic polynucleotide
ttttttttgtgggacggtattacttttttttt

SEQ ID NO: 7076 - DNA, 32 bp, Artificial Sequence
  Synthetic polynucleotide
gagggaactgcgatcattagtgaggtttcctt

SEQ ID NO: 7077 - DNA, 32 bp, Artificial Sequence
  Synthetic polynucleotide
ccaggtcaagttttggcttacatcgcccccta

SEQ ID NO: 7078 - DNA, 32 bp, Artificial Sequence
  Synthetic polynucleotide
ttttttttttatgctaaattctcatttttttt

SEQ ID NO: 7079 - DNA, 32 bp, Artificial Sequence
  Synthetic polynucleotide
agatgttctcagtcgtcgagtcgtaacctcgt

SEQ ID NO: 7080 - DNA, 32 bp, Artificial Sequence
  Synthetic polynucleotide
ataatagtttaatttgagtttcctcagaagtg

SEQ ID NO: 7081 - DNA, 32 bp, Artificial Sequence
  Synthetic polynucleotide
ttttttttcacccccgaactactgtttttttt

SEQ ID NO: 7082 - DNA, 32 bp, Artificial Sequence
  Synthetic polynucleotide
gccggagtttttttttttttttttggggtcgt

SEQ ID NO: 7083 - DNA, 32 bp, Artificial Sequence
  Synthetic polynucleotide
cccagtgaccaaggagggaatgcaacaccggc

SEQ ID NO: 7084 - DNA, 32 bp, Artificial Sequence
  Synthetic polynucleotide
ctaatatagtatagcgctcgacggaggatatg

SEQ ID NO: 7085 - DNA, 32 bp, Artificial Sequence
  Synthetic polynucleotide
tctttctctgggtaagatgtggttccattacg

SEQ ID NO: 7086 - DNA, 32 bp, Artificial Sequence
  Synthetic polynucleotide
cacgcgagccaccgcaatcgactaggaaggac

SEQ ID NO: 7087 - DNA, 32 bp, Artificial Sequence
  Synthetic polynucleotide
ttttttttagacgtgcactttctgtttttttt

SEQ ID NO: 7088 - DNA, 32 bp, Artificial Sequence
  Synthetic polynucleotide
aacagtccttttttttttttttttggggatga

SEQ ID NO: 7089 - DNA, 32 bp, Artificial Sequence
  Synthetic polynucleotide
gatagctgctatgtagatctggtcattgaaag

SEQ ID NO: 7090 - DNA, 32 bp, Artificial Sequence
  Synthetic polynucleotide
gacagggagaatatggaaagactgtgcgagat

SEQ ID NO: 7091 - DNA, 32 bp, Artificial Sequence
  Synthetic polynucleotide
ggtcagaagctcgacaagctctgttcctatga

SEQ ID NO: 7092 - DNA, 32 bp, Artificial Sequence
  Synthetic polynucleotide
cccccaagtgagctttgagtcggcctgacaga

SEQ ID NO: 7093 - DNA, 32 bp, Artificial Sequence
  Synthetic polynucleotide
ttttttttgtatatcaggcggtactttttttt

SEQ ID NO: 7094 - DNA, 32 bp, Artificial Sequence
  Synthetic polynucleotide
tcacattattttttttttttttttctcccggt

SEQ ID NO: 7095 - DNA, 32 bp, Artificial Sequence
  Synthetic polynucleotide
tcatccggacgcttagcgcccactctatgaac

SEQ ID NO: 7096 - DNA, 32 bp, Artificial Sequence
  Synthetic polynucleotide
ggcgcatattcataacacactgacaccctttt

SEQ ID NO: 7097 - DNA, 32 bp, Artificial Sequence
  Synthetic polynucleotide
cctatcttggatatcgcagcccattacccaca

SEQ ID NO: 7098 - DNA, 32 bp, Artificial Sequence
  Synthetic polynucleotide
agctgttcgctgtgaccagagccgaggtcagg

SEQ ID NO: 7099 - DNA, 32 bp, Artificial Sequence
  Synthetic polynucleotide
ttttttttctgctctaacatgtaatttttttt

SEQ ID NO: 7100 - DNA, 32 bp, Artificial Sequence
  Synthetic polynucleotide
cataggtatttttttttttttttttactctga

SEQ ID NO: 7101 - DNA, 32 bp, Artificial Sequence
  Synthetic polynucleotide
ctaacgattccccgtctccaaaccaaattgtg

SEQ ID NO: 7102 - DNA, 32 bp, Artificial Sequence
  Synthetic polynucleotide
agattgtatcgagaaagcaccgaaaaaagccc

SEQ ID NO: 7103 - DNA, 32 bp, Artificial Sequence
  Synthetic polynucleotide
atcagttattacttcgtgcccatggtgacacg

SEQ ID NO: 7104 - DNA, 32 bp, Artificial Sequence
  Synthetic polynucleotide
gtccaacaaggagaaaaacagcatggcttcat

SEQ ID NO: 7105 - DNA, 32 bp, Artificial Sequence
  Synthetic polynucleotide
ttttttttacgcttacgacgaggttttttttt

SEQ ID NO: 7106 - DNA, 32 bp, Artificial Sequence
  Synthetic polynucleotide
ctcgtgctttttttttttttttttataggaca

SEQ ID NO: 7107 - DNA, 32 bp, Artificial Sequence
  Synthetic polynucleotide
aggtggcctgataatctcccacgtacaacata

SEQ ID NO: 7108 - DNA, 32 bp, Artificial Sequence
  Synthetic polynucleotide
ctaccgctcccgagccagttcgtatatgctct

SEQ ID NO: 7109 - DNA, 32 bp, Artificial Sequence
  Synthetic polynucleotide
cttgacgagtgggaggtaattagtacggccac

SEQ ID NO: 7110 - DNA, 32 bp, Artificial Sequence
  Synthetic polynucleotide
gaccatagaaagcagggatactttgaaaaggc

SEQ ID NO: 7111 - DNA, 32 bp, Artificial Sequence
  Synthetic polynucleotide
ttttttttatattaaggagtgcaatttttttt

SEQ ID NO: 7112 - DNA, 32 bp, Artificial Sequence
  Synthetic polynucleotide
tcagacgcttttttttttttttttcttgcctc

SEQ ID NO: 7113 - DNA, 32 bp, Artificial Sequence
  Synthetic polynucleotide
aatgcacaaccataccaacggcgaataaaagc

SEQ ID NO: 7114 - DNA, 32 bp, Artificial Sequence
  Synthetic polynucleotide
cgtgcacatcacgtggcctctccctgccgagg

SEQ ID NO: 7115 - DNA, 32 bp, Artificial Sequence
  Synthetic polynucleotide
agtacgacatccctgaacggggttggggcata

SEQ ID NO: 7116 - DNA, 32 bp, Artificial Sequence
  Synthetic polynucleotide
agtatagtttgctttagaggcggcatcgggtt

SEQ ID NO: 7117 - DNA, 32 bp, Artificial Sequence
  Synthetic polynucleotide
ttttttttagtgcgtaccagtccctttttttt

SEQ ID NO: 7118 - DNA, 32 bp, Artificial Sequence
  Synthetic polynucleotide
gcaattgcttttttttttttttttttctggtc

SEQ ID NO: 7119 - DNA, 32 bp, Artificial Sequence
  Synthetic polynucleotide
cacttgaggcaacctaggtaggttccgccgca

SEQ ID NO: 7120 - DNA, 32 bp, Artificial Sequence
  Synthetic polynucleotide
caggctacactgttagggtacacggcctgttt

SEQ ID NO: 7121 - DNA, 32 bp, Artificial Sequence
  Synthetic polynucleotide
atgtagcagcgcgccttcaaggcccgacatcc

SEQ ID NO: 7122 - DNA, 32 bp, Artificial Sequence
  Synthetic polynucleotide
tatggtttagaaactgtaggttaaatcagcta

SEQ ID NO: 7123 - DNA, 32 bp, Artificial Sequence
  Synthetic polynucleotide
ttttttttgccctcagtgtactactttttttt

SEQ ID NO: 7124 - DNA, 32 bp, Artificial Sequence
  Synthetic polynucleotide
aatgattattttttttttttttttgcgtatcc

SEQ ID NO: 7125 - DNA, 32 bp, Artificial Sequence
  Synthetic polynucleotide
cgaatcaaggagcacttcgcaacgaggacgat

SEQ ID NO: 7126 - DNA, 32 bp, Artificial Sequence
  Synthetic polynucleotide
actgtacgtatgtgatgtcgcatatatcccaa

SEQ ID NO: 7127 - DNA, 32 bp, Artificial Sequence
  Synthetic polynucleotide
atatcaagggttggttcggcatgcggtctaaa

SEQ ID NO: 7128 - DNA, 32 bp, Artificial Sequence
  Synthetic polynucleotide
catatattgtccctcagctatgctaggtagag

SEQ ID NO: 7129 - DNA, 32 bp, Artificial Sequence
  Synthetic polynucleotide
ttttttttgaccaagttgattagctttttttt

SEQ ID NO: 7130 - DNA, 32 bp, Artificial Sequence
  Synthetic polynucleotide
tggtggttttttttttttttttttgaaggagt

SEQ ID NO: 7131 - DNA, 32 bp, Artificial Sequence
  Synthetic polynucleotide
ctaatgaagaggatgtacttgggattaggatc

SEQ ID NO: 7132 - DNA, 32 bp, Artificial Sequence
  Synthetic polynucleotide
cgaccatgttccgccctggagttagatgtccg

SEQ ID NO: 7133 - DNA, 32 bp, Artificial Sequence
  Synthetic polynucleotide
ctcggccccagtagaaagcctacgtccgtgca

SEQ ID NO: 7134 - DNA, 32 bp, Artificial Sequence
  Synthetic polynucleotide
aataaggagcccagcggtttgaacctgtttac

SEQ ID NO: 7135 - DNA, 32 bp, Artificial Sequence
  Synthetic polynucleotide
ttttttttcgatcgcctcttgctttttttttt

SEQ ID NO: 7136 - DNA, 32 bp, Artificial Sequence
  Synthetic polynucleotide
gcggccattttttttttttttttttcgttcga

SEQ ID NO: 7137 - DNA, 32 bp, Artificial Sequence
  Synthetic polynucleotide
tactaaaataagccacagagtatagatggccg

SEQ ID NO: 7138 - DNA, 32 bp, Artificial Sequence
  Synthetic polynucleotide
ggaggcggtgggtgttccaagtcagcccctcg

SEQ ID NO: 7139 - DNA, 32 bp, Artificial Sequence
  Synthetic polynucleotide
tagtttgatgactaccgattgccgtaaatggt

SEQ ID NO: 7140 - DNA, 32 bp, Artificial Sequence
  Synthetic polynucleotide
tttttgtcgctgtattgtcgctggctaatcac

SEQ ID NO: 7141 - DNA, 32 bp, Artificial Sequence
  Synthetic polynucleotide
ttttttttcaaatctgttggctgatttttttt

SEQ ID NO: 7142 - DNA, 32 bp, Artificial Sequence
  Synthetic polynucleotide
ccccggtattttttttttttttttcaaacatt

SEQ ID NO: 7143 - DNA, 32 bp, Artificial Sequence
  Synthetic polynucleotide
tagtccacgctgttcaacactaatccgggtat

SEQ ID NO: 7144 - DNA, 32 bp, Artificial Sequence
  Synthetic polynucleotide
ccgcacgtgcgctttccgtcttaaacgacttt

SEQ ID NO: 7145 - DNA, 32 bp, Artificial Sequence
  Synthetic polynucleotide
cctactctaggagaagcacgacgacgggaatt

SEQ ID NO: 7146 - DNA, 32 bp, Artificial Sequence
  Synthetic polynucleotide
ggcgatacgcactgccttccgcgtgggtatag

SEQ ID NO: 7147 - DNA, 32 bp, Artificial Sequence
  Synthetic polynucleotide
ttttttttatacacaacagagcgttttttttt

SEQ ID NO: 7148 - DNA, 32 bp, Artificial Sequence
  Synthetic polynucleotide
gctcgacctttttttttttttttttctagcag

SEQ ID NO: 7149 - DNA, 32 bp, Artificial Sequence
  Synthetic polynucleotide
cagaaactagtggagctgtcgtataatgggta

SEQ ID NO: 7150 - DNA, 32 bp, Artificial Sequence
  Synthetic polynucleotide
gaggtagcaggtctacgtgtcaagggaagttc

SEQ ID NO: 7151 - DNA, 32 bp, Artificial Sequence
  Synthetic polynucleotide
actctcgtgcgtatcgtcctcggtagggtgta

SEQ ID NO: 7152 - DNA, 32 bp, Artificial Sequence
  Synthetic polynucleotide
cgagatgtatgccagctcatacgacaagaact

SEQ ID NO: 7153 - DNA, 32 bp, Artificial Sequence
  Synthetic polynucleotide
ttttttttcacctttcaccgaagctttttttt

SEQ ID NO: 7154 - DNA, 32 bp, Artificial Sequence; identical to SEQ ID NO: 6662
  Synthetic polynucleotide

SEQ ID NO: 7155 - DNA, 32 bp, Artificial Sequence
  Synthetic polynucleotide
cgtcgtcttctcataaaaaccgttatggtttc

SEQ ID NO: 7156 - DNA, 32 bp, Artificial Sequence
  Synthetic polynucleotide
tggatatcaggagatctaactaagtggggcac

SEQ ID NO: 7157 - DNA, 32 bp, Artificial Sequence
  Synthetic polynucleotide
tcaagctgatgtaccgaacagtgagctattcg

SEQ ID NO: 7158 - DNA, 32 bp, Artificial Sequence
  Synthetic polynucleotide
ccccaagtgtcttgcgggtacacctcacttgc

SEQ ID NO: 7159 - DNA, 32 bp, Artificial Sequence
  Synthetic polynucleotide
ttttttttatcttagtaattcatatttttttt

SEQ ID NO: 7160 - DNA, 32 bp, Artificial Sequence
  Synthetic polynucleotide
cgaatcgcttttttttttttttttctaatccc

SEQ ID NO: 7161 - DNA, 32 bp, Artificial Sequence
  Synthetic polynucleotide
tcgtacaggctacatggcagtccgatgttggg

SEQ ID NO: 7162 - DNA, 32 bp, Artificial Sequence
  Synthetic polynucleotide
tatttgacggactcatcctacaatagctttat

SEQ ID NO: 7163 - DNA, 32 bp, Artificial Sequence
  Synthetic polynucleotide
tgtgggctagcacgcatttcaacttcttgcca

SEQ ID NO: 7164 - DNA, 32 bp, Artificial Sequence
  Synthetic polynucleotide
ctaggacctgtcaagtgtgcagctatccgaat

SEQ ID NO: 7165 - DNA, 32 bp, Artificial Sequence
  Synthetic polynucleotide
tttttttttctgcaactatccttttttttttt

SEQ ID NO: 7166 - DNA, 32 bp, Artificial Sequence
  Synthetic polynucleotide
actacgcttttttttttttttttttcgggcac

SEQ ID NO: 7167 - DNA, 32 bp, Artificial Sequence
  Synthetic polynucleotide
tacgctattaaccctttaagcgcgcacccgtt

SEQ ID NO: 7168 - DNA, 32 bp, Artificial Sequence
  Synthetic polynucleotide
gtgggagagtccggtcgtgggtaagttatgga

SEQ ID NO: 7169 - DNA, 32 bp, Artificial Sequence
  Synthetic polynucleotide
agaaccggttggacgggcctggccctacttca

SEQ ID NO: 7170 - DNA, 32 bp, Artificial Sequence
  Synthetic polynucleotide
ccatgaaaactctagccggtgagattccccag

SEQ ID NO: 7171 - DNA, 32 bp, Artificial Sequence
  Synthetic polynucleotide
ttttttttcatcgccggatgctattttttttt

SEQ ID NO: 7172 - DNA, 32 bp, Artificial Sequence
  Synthetic polynucleotide
tacatacgttttttttttttttttcgcgagca

SEQ ID NO: 7173 - DNA, 32 bp, Artificial Sequence
  Synthetic polynucleotide
tacttgaatcgcgtcgccacaaagggtgtcag

SEQ ID NO: 7174 - DNA, 32 bp, Artificial Sequence
  Synthetic polynucleotide
gcgccagatcaccgaacgtacgcatacgattt

SEQ ID NO: 7175 - DNA, 32 bp, Artificial Sequence
  Synthetic polynucleotide
cggggagggtcctcacctctccgccatattgt

SEQ ID NO: 7176 - DNA, 32 bp, Artificial Sequence
  Synthetic polynucleotide
agcaggtcttgtaatgacgactctcatctgat

SEQ ID NO: 7177 - DNA, 32 bp, Artificial Sequence
  Synthetic polynucleotide
tttttttttgtcgaaaatcgctcatttttttt

SEQ ID NO: 7178 - DNA, 32 bp, Artificial Sequence
  Synthetic polynucleotide
agttactgttttttttttttttttgcttaggg

SEQ ID NO: 7179 - DNA, 32 bp, Artificial Sequence
  Synthetic polynucleotide
aattcatcgttaatgcgtgcatctacatggtc

SEQ ID NO: 7180 - DNA, 32 bp, Artificial Sequence
  Synthetic polynucleotide
tgcttatcccgaacgaggaacttgatgtcatg

SEQ ID NO: 7181 - DNA, 32 bp, Artificial Sequence
  Synthetic polynucleotide
aaagcttcggtccttcaattagaagtcgaatt

SEQ ID NO: 7182 - DNA, 32 bp, Artificial Sequence
  Synthetic polynucleotide
attaatacggctagaatgctggtgaaagatac

SEQ ID NO: 7183 - DNA, 32 bp, Artificial Sequence
  Synthetic polynucleotide
ttttttttggcgcggcgtgcgctttttttttt

SEQ ID NO: 7184 - DNA, 32 bp, Artificial Sequence
  Synthetic polynucleotide
agacactattttttttttttttttgcgaaaat

SEQ ID NO: 7185 - DNA, 32 bp, Artificial Sequence
  Synthetic polynucleotide
cgtcacttgacttgattgttttcgctaggtgg

SEQ ID NO: 7186 - DNA, 32 bp, Artificial Sequence
  Synthetic polynucleotide
gcttctcggctgaggactcgttcgggtgctac

SEQ ID NO: 7187 - DNA, 32 bp, Artificial Sequence
  Synthetic polynucleotide
gccttgtcatctataccgggtgtccctcaagc

SEQ ID NO: 7188 - DNA, 32 bp, Artificial Sequence
  Synthetic polynucleotide
gaggagcgctgaagcggcgttaaactgcccag

SEQ ID NO: 7189 - DNA, 32 bp, Artificial Sequence
  Synthetic polynucleotide
tttttttttaattcccttatcatgtttttttt

SEQ ID NO: 7190 - DNA, 32 bp, Artificial Sequence
  Synthetic polynucleotide
gaggtggtttttttttttttttttttacttgc

SEQ ID NO: 7191 - DNA, 32 bp, Artificial Sequence
  Synthetic polynucleotide
acccgagatgacatcgtctgatggatctcagc

SEQ ID NO: 7192 - DNA, 32 bp, Artificial Sequence
  Synthetic polynucleotide
cccatggacccgctcgccacatgaaccgctct

SEQ ID NO: 7193 - DNA, 32 bp, Artificial Sequence
  Synthetic polynucleotide
gcctgtgatggtgaatactcgctagtcaactt

SEQ ID NO: 7194 - DNA, 32 bp, Artificial Sequence
  Synthetic polynucleotide
accagttccgtagttcgtaaacgataggtttc

SEQ ID NO: 7195 - DNA, 32 bp, Artificial Sequence
  Synthetic polynucleotide
ttttttttggtgatctattcggattttttttt

SEQ ID NO: 7196 - DNA, 32 bp, Artificial Sequence
  Synthetic polynucleotide
agccgaacttttttttttttttttcccccgca

SEQ ID NO: 7197 - DNA, 32 bp, Artificial Sequence
  Synthetic polynucleotide
tcacagtgcacaaggggattgggtatgaaaac

SEQ ID NO: 7198 - DNA, 32 bp, Artificial Sequence
  Synthetic polynucleotide
ccccggaagtggaaatgccactacgatattca

SEQ ID NO: 7199 - DNA, 32 bp, Artificial Sequence
  Synthetic polynucleotide
ggagaatcttgatttaccgaattatggtgtgt

SEQ ID NO: 7200 - DNA, 32 bp, Artificial Sequence
  Synthetic polynucleotide
gctctaaagctgccattctggttccccactgt

SEQ ID NO: 7201 - DNA, 32 bp, Artificial Sequence
  Synthetic polynucleotide
ttttttttacggccggcaattccctttttttt

SEQ ID NO: 7202 - DNA, 32 bp, Artificial Sequence
  Synthetic polynucleotide
ccgagatttttttttttttttttttgctgggt

SEQ ID NO: 7203 - DNA, 32 bp, Artificial Sequence
  Synthetic polynucleotide
tctgatattaaggaatcggacggaaaactaca

SEQ ID NO: 7204 - DNA, 32 bp, Artificial Sequence
  Synthetic polynucleotide
ctggttttctgtgctccccgagtccagcatta

SEQ ID NO: 7205 - DNA, 32 bp, Artificial Sequence
  Synthetic polynucleotide
ccgtaatcgattgcgcgtaatggtcgtagtgg

SEQ ID NO: 7206 - DNA, 32 bp, Artificial Sequence
  Synthetic polynucleotide
tgccatgactaagccgtataaagcgtttggaa

SEQ ID NO: 7207 - DNA, 32 bp, Artificial Sequence
  Synthetic polynucleotide
ttttttttttcgtttagaacgatatttttttt

SEQ ID NO: 7208 - DNA, 32 bp, Artificial Sequence
  Synthetic polynucleotide
ccctccacttttttttttttttttttgccacc

SEQ ID NO: 7209 - DNA, 32 bp, Artificial Sequence
  Synthetic polynucleotide
accaatcaaataacttctgtatgaatctatgt

SEQ ID NO: 7210 - DNA, 32 bp, Artificial Sequence
  Synthetic polynucleotide
gataatactacactaatgcggcgccctgcgaa

SEQ ID NO: 7211 - DNA, 32 bp, Artificial Sequence
  Synthetic polynucleotide
ttctgctaattgacgcccaccttattacgagt

SEQ ID NO: 7212 - DNA, 32 bp, Artificial Sequence
  Synthetic polynucleotide
cttcgtcagcaaattatacgagctagacctgt

SEQ ID NO: 7213 - DNA, 32 bp, Artificial Sequence
  Synthetic polynucleotide
ttttttttacggtatttcgtattatttttttt

SEQ ID NO: 7214 - DNA, 32 bp, Artificial Sequence
  Synthetic polynucleotide
aagcctgattttttttttttttttggtccggg

SEQ ID NO: 7215 - DNA, 32 bp, Artificial Sequence
  Synthetic polynucleotide
aggaggtgtgacggagctagagctactcgccg

SEQ ID NO: 7216 - DNA, 32 bp, Artificial Sequence
  Synthetic polynucleotide
ctcccacaaccctaacatagaatataggtcac

SEQ ID NO: 7217 - DNA, 32 bp, Artificial Sequence
  Synthetic polynucleotide
ggactatttaatgatctgtaccattatcaaag

SEQ ID NO: 7218 - DNA, 32 bp, Artificial Sequence
  Synthetic polynucleotide
agtaattgcatttcttcgcggaactttaaacc

SEQ ID NO: 7219 - DNA, 32 bp, Artificial Sequence
  Synthetic polynucleotide
ttttttttgtacaaatttacgccctttttttt

SEQ ID NO: 7220 - DNA, 32 bp, Artificial Sequence
  Synthetic polynucleotide
cgttactgtttttttttttttttttccagaat

SEQ ID NO: 7221 - DNA, 32 bp, Artificial Sequence
  Synthetic polynucleotide
tactggagtcgctttttaacacttggtctcga

SEQ ID NO: 7222 - DNA, 32 bp, Artificial Sequence
  Synthetic polynucleotide
gatgaacaaatggcaaagcacgtagagataat

SEQ ID NO: 7223 - DNA, 32 bp, Artificial Sequence
  Synthetic polynucleotide
accattgtgggtgaccatagaatgctattgag

SEQ ID NO: 7224 - DNA, 32 bp, Artificial Sequence
  Synthetic polynucleotide
cagtgcggcaaaagatgttatacaggtccggc

SEQ ID NO: 7225 - DNA, 32 bp, Artificial Sequence
  Synthetic polynucleotide
tttttttttcagattctcctgtcgtttttttt

SEQ ID NO: 7226 - DNA, 32 bp, Artificial Sequence
  Synthetic polynucleotide
agtgtctcttttttttttttttttttacttgg

SEQ ID NO: 7227 - DNA, 32 bp, Artificial Sequence
  Synthetic polynucleotide
gggagctgagtaaatgggtagaaggaactctg

SEQ ID NO: 7228 - DNA, 32 bp, Artificial Sequence
  Synthetic polynucleotide
ttatattaacttacctcactcgcacttagatc

SEQ ID NO: 7229 - DNA, 32 bp, Artificial Sequence
  Synthetic polynucleotide
acttaatacgcggacagcggtaacatcacata

SEQ ID NO: 7230 - DNA, 32 bp, Artificial Sequence
  Synthetic polynucleotide
caggcaagcggcgaaaacttacgtgtagtgtc

SEQ ID NO: 7231 - DNA, 32 bp, Artificial Sequence
  Synthetic polynucleotide
tttttttttattggccggagtcattttttttt

SEQ ID NO: 7232 - DNA, 32 bp, Artificial Sequence
  Synthetic polynucleotide
gaattatattttttttttttttttatagtgga

SEQ ID NO: 7233 - DNA, 32 bp, Artificial Sequence
  Synthetic polynucleotide
attactggcacaggatctggtctcaaacgtcc

SEQ ID NO: 7234 - DNA, 32 bp, Artificial Sequence
  Synthetic polynucleotide
aatgttctttcaggctacctatatagccattt

SEQ ID NO: 7235 - DNA, 32 bp, Artificial Sequence
  Synthetic polynucleotide
gcagggtgcgaacccgaactcatatacgtctt

SEQ ID NO: 7236 - DNA, 32 bp, Artificial Sequence
  Synthetic polynucleotide
gagctcacccgtcgatcgaccattggtcattg

SEQ ID NO: 7237 - DNA, 32 bp, Artificial Sequence
  Synthetic polynucleotide
ttttttttccacgtagaattatcatttttttt

SEQ ID NO: 7238 - DNA, 32 bp, Artificial Sequence
  Synthetic polynucleotide
agttagatttttttttttttttttgagaaccg

SEQ ID NO: 7239 - DNA, 32 bp, Artificial Sequence
  Synthetic polynucleotide
gccgatggaaaaatcactgctcctttagggtc

SEQ ID NO: 7240 - DNA, 32 bp, Artificial Sequence
  Synthetic polynucleotide
ctagtaactcaatttttaccgagcaaagtatt

SEQ ID NO: 7241 - DNA, 32 bp, Artificial Sequence
  Synthetic polynucleotide
cctaggcgcaaggcgcgaatatccccggttga

SEQ ID NO: 7242 - DNA, 32 bp, Artificial Sequence
  Synthetic polynucleotide
cgtttattgaggttagcgctgatccggtttac

SEQ ID NO: 7243 - DNA, 32 bp, Artificial Sequence
  Synthetic polynucleotide
ttttttttttaagtatgtcggaagtttttttt

SEQ ID NO: 7244 - DNA, 32 bp, Artificial Sequence
  Synthetic polynucleotide
agtctacgtttttttttttttttttatgccct

SEQ ID NO: 7245 - DNA, 32 bp, Artificial Sequence
  Synthetic polynucleotide
aagagcaattatgtgaccccttcgtttaaaga

SEQ ID NO: 7246 - DNA, 32 bp, Artificial Sequence
  Synthetic polynucleotide
ctgaaggaagacgtcctggctcgtacccatcc

SEQ ID NO: 7247 - DNA, 32 bp, Artificial Sequence
  Synthetic polynucleotide
agggttcataggcggaagatgcgatttgtacg

SEQ ID NO: 7248 - DNA, 32 bp, Artificial Sequence
  Synthetic polynucleotide
taggcaagcgatagtagaaaactgcacaactt

SEQ ID NO: 7249 - DNA, 32 bp, Artificial Sequence
  Synthetic polynucleotide
ttttttttgggcacgattacctgctttttttt

SEQ ID NO: 7250 - DNA, 32 bp, Artificial Sequence
  Synthetic polynucleotide
taggtggtttttttttttttttttcagctcca

SEQ ID NO: 7251 - DNA, 32 bp, Artificial Sequence
  Synthetic polynucleotide
cctagaactaagaacacccgacaaggcagcag

SEQ ID NO: 7252 - DNA, 32 bp, Artificial Sequence
  Synthetic polynucleotide
tggtcggtccccgctccaacattttatctctt

SEQ ID NO: 7253 - DNA, 32 bp, Artificial Sequence
  Synthetic polynucleotide
tgggagaatagcgcctgcgcgggctgactctt

SEQ ID NO: 7254 - DNA, 32 bp, Artificial Sequence
  Synthetic polynucleotide
ggtatttttatccatttgatcctgcgtacctt

SEQ ID NO: 7255 - DNA, 32 bp, Artificial Sequence
  Synthetic polynucleotide
ttttttttccggcgaatggaatactttttttt

SEQ ID NO: 7256 - DNA, 32 bp, Artificial Sequence
  Synthetic polynucleotide
ggttcgtgttttttttttttttttgctcgtat

SEQ ID NO: 7257 - DNA, 32 bp, Artificial Sequence
  Synthetic polynucleotide
gcccgacggatgcgttgatgatatggtaatcc

SEQ ID NO: 7258 - DNA, 32 bp, Artificial Sequence
  Synthetic polynucleotide
acctaatgcgaaggtcgccagtaggccgggct

SEQ ID NO: 7259 - DNA, 32 bp, Artificial Sequence
  Synthetic polynucleotide
gatatcgctataataggctgatgccctgcttc

SEQ ID NO: 7260 - DNA, 32 bp, Artificial Sequence
  Synthetic polynucleotide
acagtgcccgcattcaccatatgacttgtact

SEQ ID NO: 7261 - DNA, 32 bp, Artificial Sequence
  Synthetic polynucleotide
ttttttttgcgccgtgtatcgtcctttttttt

SEQ ID NO: 7262 - DNA, 32 bp, Artificial Sequence
  Synthetic polynucleotide
actgaaagttttttttttttttttggctccaa

SEQ ID NO: 7263 - DNA, 32 bp, Artificial Sequence
  Synthetic polynucleotide
tattgaagacactcaccccgcgtatcgggaca

SEQ ID NO: 7264 - DNA, 32 bp, Artificial Sequence
  Synthetic polynucleotide
aggtcatcctacaactgcactaagcgcctccg

SEQ ID NO: 7265 - DNA, 32 bp, Artificial Sequence
  Synthetic polynucleotide
ttacacataggctgcgaagttgaatcgtctac

SEQ ID NO: 7266 - DNA, 32 bp, Artificial Sequence
  Synthetic polynucleotide
gctgtgccgcccaccacgtcccatattttata

SEQ ID NO: 7267 - DNA, 32 bp, Artificial Sequence
  Synthetic polynucleotide
ttttttttatcgccaatcaaggaatttttttt

SEQ ID NO: 7268 - DNA, 32 bp, Artificial Sequence
  Synthetic polynucleotide
ggtcagacttttttttttttttttagacaatg

SEQ ID NO: 7269 - DNA, 32 bp, Artificial Sequence
  Synthetic polynucleotide
caaagggcatgtgaagcgatgcttttgccaca

SEQ ID NO: 7270 - DNA, 32 bp, Artificial Sequence
  Synthetic polynucleotide
aggatggcgtgaaccctaacagcaggtcggcc

SEQ ID NO: 7271 - DNA, 32 bp, Artificial Sequence
  Synthetic polynucleotide
tttacgctaagcgggtacatgaggtggctggt

SEQ ID NO: 7272 - DNA, 32 bp, Artificial Sequence
  Synthetic polynucleotide
gtggcgctgtcaagacataccctattgtcgtt

SEQ ID NO: 7273 - DNA, 32 bp, Artificial Sequence
  Synthetic polynucleotide
ttttttttttggggactacgatgatttttttt

SEQ ID NO: 7274 - DNA, 32 bp, Artificial Sequence
  Synthetic polynucleotide
cactccaattttttttttttttttgttcccct

SEQ ID NO: 7275 - DNA, 32 bp, Artificial Sequence
  Synthetic polynucleotide
acgggacattgttcatacttggacaaagtgag

SEQ ID NO: 7276 - DNA, 32 bp, Artificial Sequence
  Synthetic polynucleotide
acattactgccctaacagtgttttatgctggg

SEQ ID NO: 7277 - DNA, 32 bp, Artificial Sequence
  Synthetic polynucleotide
agtaacgcggcactagcgtgacggtgaatctt

SEQ ID NO: 7278 - DNA, 32 bp, Artificial Sequence
  Synthetic polynucleotide
cataccgtagcgggtcatcatgagttttttgt

SEQ ID NO: 7279 - DNA, 32 bp, Artificial Sequence
  Synthetic polynucleotide
ttttttttcttctttcgaagaggttttttttt

SEQ ID NO: 7280 - DNA, 32 bp, Artificial Sequence
  Synthetic polynucleotide
ctgctgtattttttttttttttttctcggcat

SEQ ID NO: 7281 - DNA, 32 bp, Artificial Sequence
  Synthetic polynucleotide
ggggactcgcgtagctgatagagaactgtccc

SEQ ID NO: 7282 - DNA, 32 bp, Artificial Sequence
  Synthetic polynucleotide
ctgaatggtattcttcttctgaatcgcgggct

SEQ ID NO: 7283 - DNA, 32 bp, Artificial Sequence
  Synthetic polynucleotide
actcgtcgcctgtgaaatcccggatcttgtat

SEQ ID NO: 7284 - DNA, 32 bp, Artificial Sequence
  Synthetic polynucleotide
agacatagatgccgttcgtaggagttgaccta

SEQ ID NO: 7285 - DNA, 32 bp, Artificial Sequence
  Synthetic polynucleotide
ttttttttcctcagaaatattgcttttttttt

SEQ ID NO: 7286 - DNA, 32 bp, Artificial Sequence
  Synthetic polynucleotide
gtgccgtattttttttttttttttcattaaga

SEQ ID NO: 7287 - DNA, 32 bp, Artificial Sequence
  Synthetic polynucleotide
tattgctcaggcctcgcttggacattgcgctt

SEQ ID NO: 7288 - DNA, 32 bp, Artificial Sequence
  Synthetic polynucleotide
cttacttgtcaatttccttccatgtaattata

SEQ ID NO: 7289 - DNA, 32 bp, Artificial Sequence
  Synthetic polynucleotide
gctcattcacgccctgttaaccataaggtccg

SEQ ID NO: 7290 - DNA, 32 bp, Artificial Sequence
  Synthetic polynucleotide
ccagcagtggtgcgtcgaccacgtcctctcct

SEQ ID NO: 7291 - DNA, 32 bp, Artificial Sequence
  Synthetic polynucleotide
ttttttttgcgcccactgctcaattttttttt

SEQ ID NO: 7292 - DNA, 32 bp, Artificial Sequence
  Synthetic polynucleotide
actgtagtttttttttttttttttccggacgc

SEQ ID NO: 7293 - DNA, 32 bp, Artificial Sequence
  Synthetic polynucleotide
ctccgcatcccggtcacgcgagaccctcacgc

SEQ ID NO: 7294 - DNA, 32 bp, Artificial Sequence
  Synthetic polynucleotide
taacaagggcctacctacacagtgtgcagggt

SEQ ID NO: 7295 - DNA, 32 bp, Artificial Sequence
  Synthetic polynucleotide
gcgacgcttgccatcgttttaacacatacatg

SEQ ID NO: 7296 - DNA, 32 bp, Artificial Sequence
  Synthetic polynucleotide
gaaggctgcactttaagagccgatggagtgtt

SEQ ID NO: 7297 - DNA, 32 bp, Artificial Sequence
  Synthetic polynucleotide
ttttttttcccgcggtccgaagtttttttttt

SEQ ID NO: 7298 - DNA, 32 bp, Artificial Sequence
  Synthetic polynucleotide
agccagagttttttttttttttttgacccaaa

SEQ ID NO: 7299 - DNA, 32 bp, Artificial Sequence
  Synthetic polynucleotide
cggcgccgcttggtaacacaaaactgccaatg

SEQ ID NO: 7300 - DNA, 32 bp, Artificial Sequence
  Synthetic polynucleotide
ggttgcggtgatcaatatcggattccggcgga

SEQ ID NO: 7301 - DNA, 32 bp, Artificial Sequence
  Synthetic polynucleotide
cccggtggcacgtaaacaggtggtctctgata

SEQ ID NO: 7302 - DNA, 32 bp, Artificial Sequence
  Synthetic polynucleotide
gttgttccggaacagactgctttttataaaaa

SEQ ID NO: 7303 - DNA, 32 bp, Artificial Sequence
  Synthetic polynucleotide
tttttttttgacaccctgcatacctttttttt

SEQ ID NO: 7304 - DNA, 32 bp, Artificial Sequence
  Synthetic polynucleotide
aaatacgattttttttttttttttgactcgag

SEQ ID NO: 7305 - DNA, 32 bp, Artificial Sequence
  Synthetic polynucleotide
atgttccgcgggcatcagtcaatctccccgga

SEQ ID NO: 7306 - DNA, 32 bp, Artificial Sequence
  Synthetic polynucleotide
gcggcgaacatcgtgccgtgggacattccacg

SEQ ID NO: 7307 - DNA, 32 bp, Artificial Sequence
  Synthetic polynucleotide
ctgctgaaaaaacgaccgggtataggagcgta

SEQ ID NO: 7308 - DNA, 32 bp, Artificial Sequence
  Synthetic polynucleotide
gccaaaatgagtaagggctaagggttttgcat

SEQ ID NO: 7309 - DNA, 32 bp, Artificial Sequence
  Synthetic polynucleotide
ttttttttcccgttcctgcctaattttttttt

SEQ ID NO: 7310 - DNA, 32 bp, Artificial Sequence
  Synthetic polynucleotide
gcggatgctttttttttttttttttgacaggt

SEQ ID NO: 7311 - DNA, 32 bp, Artificial Sequence
  Synthetic polynucleotide
gcgccagaccatgcgattgttgcggcctcgtg

SEQ ID NO: 7312 - DNA, 32 bp, Artificial Sequence
  Synthetic polynucleotide
ggcggatactaagccggacccaggtaggttat

SEQ ID NO: 7313 - DNA, 32 bp, Artificial Sequence
  Synthetic polynucleotide
cgtcctgtgcgagatatagatgcgactacacc

SEQ ID NO: 7314 - DNA, 32 bp, Artificial Sequence
  Synthetic polynucleotide
cagagatggagaacattcacataccagctgga

SEQ ID NO: 7315 - DNA, 32 bp, Artificial Sequence
  Synthetic polynucleotide
ttttttttcgtcgaggtaacatcgtttttttt

SEQ ID NO: 7316 - DNA, 32 bp, Artificial Sequence
  Synthetic polynucleotide
gcgcccacttttttttttttttttacattgta

SEQ ID NO: 7317 - DNA, 32 bp, Artificial Sequence
  Synthetic polynucleotide
atattgtaaacggtttagcgtgatgcaggcgt

SEQ ID NO: 7318 - DNA, 32 bp, Artificial Sequence
  Synthetic polynucleotide
accttcaaatataactccatattaacctgcca

SEQ ID NO: 7319 - DNA, 32 bp, Artificial Sequence
  Synthetic polynucleotide
gactctcttggttcaacgatgcgggcgagggt

SEQ ID NO: 7320 - DNA, 32 bp, Artificial Sequence
  Synthetic polynucleotide
ctcaataaagggctgcgcatgagaggcgcaga

SEQ ID NO: 7321 - DNA, 32 bp, Artificial Sequence
  Synthetic polynucleotide
ttttttttagataggtattacgactttttttt

SEQ ID NO: 7322 - DNA, 32 bp, Artificial Sequence
  Synthetic polynucleotide
tcgcacgattttttttttttttttctccattg

SEQ ID NO: 7323 - DNA, 32 bp, Artificial Sequence
  Synthetic polynucleotide
ttgtgaacttgcggggagtgtggtctgtttaa

SEQ ID NO: 7324 - DNA, 32 bp, Artificial Sequence
  Synthetic polynucleotide
ctgtactataacggccgactctaccctgggaa

SEQ ID NO: 7325 - DNA, 32 bp, Artificial Sequence
  Synthetic polynucleotide
catcacggttttttttttttttttcaaggacg

SEQ ID NO: 7326 - DNA, 32 bp, Artificial Sequence
  Synthetic polynucleotide
atcccctcatcgctgacatcttaacgaccgtt

SEQ ID NO: 7327 - DNA, 32 bp, Artificial Sequence
  Synthetic polynucleotide
cgatagaagtagttaaagaactcttgatgtcc

SEQ ID NO: 7328 - DNA, 32 bp, Artificial Sequence
  Synthetic polynucleotide
aacatggtttttttttttttttttttgccctt

SEQ ID NO: 7329 - DNA, 32 bp, Artificial Sequence
  Synthetic polynucleotide
ttgtcttatcaccctacatacacaccacaatg

SEQ ID NO: 7330 - DNA, 32 bp, Artificial Sequence
  Synthetic polynucleotide
tcatggtaaccgtgggaaactgagtaagacct

SEQ ID NO: 7331 - DNA, 32 bp, Artificial Sequence
  Synthetic polynucleotide
gattcatattttttttttttttttatgtgtac

SEQ ID NO: 7332 - DNA, 32 bp, Artificial Sequence
  Synthetic polynucleotide
cacttgactggagtaggttagtggtggcaccc

SEQ ID NO: 7333 - DNA, 32 bp, Artificial Sequence
  Synthetic polynucleotide
agacgcctgcgaccgatccctaaatgtccgtg

SEQ ID NO: 7334 - DNA, 32 bp, Artificial Sequence
  Synthetic polynucleotide
ggagggtattttttttttttttttcatgttgt

SEQ ID NO: 7335 - DNA, 32 bp, Artificial Sequence
  Synthetic polynucleotide
gctctggaggggatgatttgcaccacctatac

SEQ ID NO: 7336 - DNA, 32 bp, Artificial Sequence
  Synthetic polynucleotide
agacgttttaggtgctaatattgcagtattcc

SEQ ID NO: 7337 - DNA, 16 bp, Artificial Sequence
  Synthetic polynucleotide
aactgttgtgtcctat

SEQ ID NO: 7338 - DNA, 16 bp, Artificial Sequence
  Synthetic polynucleotide
gtttacttagggatgg

SEQ ID NO: 7339 - DNA, 16 bp, Artificial Sequence
  Synthetic polynucleotide
tacgaactcaacgcac

SEQ ID NO: 7340 - DNA, 16 bp, Artificial Sequence
  Synthetic polynucleotide
gctcgggtagtctcaa

SEQ ID NO: 7341 - DNA, 16 bp, Artificial Sequence
  Synthetic polynucleotide
gaagatagagagcata

SEQ ID NO: 7342 - DNA, 16 bp, Artificial Sequence
  Synthetic polynucleotide
aattcgctaaaccgga

SEQ ID NO: 7343 - DNA, 16 bp, Artificial Sequence
  Synthetic polynucleotide
aaagtatccgcatctc

SEQ ID NO: 7344 - DNA, 16 bp, Artificial Sequence
  Synthetic polynucleotide
actcagtgatcgagta

SEQ ID NO: 7345 - DNA, 16 bp, Artificial Sequence
  Synthetic polynucleotide
ttcatgtcgccttttc

SEQ ID NO: 7346 - DNA, 16 bp, Artificial Sequence
  Synthetic polynucleotide
gaacggtgacacactt

SEQ ID NO: 7347 - DNA, 16 bp, Artificial Sequence
  Synthetic polynucleotide
gtgttcattcagagta

SEQ ID NO: 7348 - DNA, 16 bp, Artificial Sequence
  Synthetic polynucleotide
gcggaaatatggccgc

SEQ ID NO: 7349 - DNA, 16 bp, Artificial Sequence
  Synthetic polynucleotide
ttcggtgcgcagcggg

SEQ ID NO: 7350 - DNA, 16 bp, Artificial Sequence
  Synthetic polynucleotide
ccgcctgtaacgctta

SEQ ID NO: 7351 - DNA, 16 bp, Artificial Sequence
  Synthetic polynucleotide
atcagcccgggctttt

SEQ ID NO: 7352 - DNA, 16 bp, Artificial Sequence
  Synthetic polynucleotide
gctaatacgctgagcg

SEQ ID NO: 7353 - DNA, 16 bp, Artificial Sequence
  Synthetic polynucleotide
atgctgttgttgcggg

SEQ ID NO: 7354 - DNA, 16 bp, Artificial Sequence
  Synthetic polynucleotide
gtttctgaaccggaac

SEQ ID NO: 7355 - DNA, 16 bp, Artificial Sequence
  Synthetic polynucleotide
ccgggctaatgaagcc

SEQ ID NO: 7356 - DNA, 16 bp, Artificial Sequence
  Synthetic polynucleotide
gtgaccccagagactg

SEQ ID NO: 7357 - DNA, 16 bp, Artificial Sequence
  Synthetic polynucleotide
tctgatgcaccgggag

SEQ ID NO: 7358 - DNA, 16 bp, Artificial Sequence
  Synthetic polynucleotide
ccagccacttagctgt

SEQ ID NO: 7359 - DNA, 16 bp, Artificial Sequence
  Synthetic polynucleotide
gtcagtgtgatcgcga

SEQ ID NO: 7360 - DNA, 16 bp, Artificial Sequence
  Synthetic polynucleotide
gttccctctagctagg

SEQ ID NO: 7361 - DNA, 16 bp, Artificial Sequence
  Synthetic polynucleotide
gtgatgccaaaagggt

SEQ ID NO: 7362 - DNA, 16 bp, Artificial Sequence
  Synthetic polynucleotide
ggatatggagctggaa

SEQ ID NO: 7363 - DNA, 16 bp, Artificial Sequence
  Synthetic polynucleotide
cggctctgatttctag

SEQ ID NO: 7364 - DNA, 16 bp, Artificial Sequence
  Synthetic polynucleotide
tgacctggtataatgg

SEQ ID NO: 7365 - DNA, 16 bp, Artificial Sequence
  Synthetic polynucleotide
cggagctacctgacct

SEQ ID NO: 7366 - DNA, 16 bp, Artificial Sequence
  Synthetic polynucleotide
caatcatacgtcccac

SEQ ID NO: 7367 - DNA, 16 bp, Artificial Sequence
  Synthetic polynucleotide
ggaaggattcatcccc

SEQ ID NO: 7368 - DNA, 16 bp, Artificial Sequence
  Synthetic polynucleotide
tttaagaatgatcgca

SEQ ID NO: 7369 - DNA, 16 bp, Artificial Sequence
  Synthetic polynucleotide
cagtctttgagatgtt

SEQ ID NO: 7370 - DNA, 16 bp, Artificial Sequence
  Synthetic polynucleotide
gaacatcttttggttg

SEQ ID NO: 7371 - DNA, 16 bp, Artificial Sequence
  Synthetic polynucleotide
gcgtaaagatctcgca

SEQ ID NO: 7372 - DNA, 16 bp, Artificial Sequence
  Synthetic polynucleotide
ttctggtgccaaaact

SEQ ID NO: 7373 - DNA, 16 bp, Artificial Sequence
  Synthetic polynucleotide
gccgactcgttcaagc

SEQ ID NO: 7374 - DNA, 16 bp, Artificial Sequence
  Synthetic polynucleotide
actattatctggctat

SEQ ID NO: 7375 - DNA, 16 bp, Artificial Sequence
  Synthetic polynucleotide
aaaagatgtctgtcag

SEQ ID NO: 7376 - DNA, 16 bp, Artificial Sequence
  Synthetic polynucleotide
cccaagcttagcataa

SEQ ID NO: 7377 - DNA, 16 bp, Artificial Sequence
  Synthetic polynucleotide
gcggctggacgacccc

SEQ ID NO: 7378 - DNA, 16 bp, Artificial Sequence
  Synthetic polynucleotide
gccgtgcgacgactga

SEQ ID NO: 7379 - DNA, 16 bp, Artificial Sequence
  Synthetic polynucleotide
gacaaacgcatatcct

SEQ ID NO: 7380 - DNA, 16 bp, Artificial Sequence
  Synthetic polynucleotide
cggcccgccaaattaa

SEQ ID NO: 7381 - DNA, 16 bp, Artificial Sequence
  Synthetic polynucleotide
gcctaaaggtccttcc

SEQ ID NO: 7382 - DNA, 16 bp, Artificial Sequence
  Synthetic polynucleotide
acggtaatcgggggtg

SEQ ID NO: 7383 - DNA, 16 bp, Artificial Sequence
  Synthetic polynucleotide
acgactcgtcgaacga

SEQ ID NO: 7384 - DNA, 16 bp, Artificial Sequence
  Synthetic polynucleotide
ggactgttctacatag

SEQ ID NO: 7385 - DNA, 16 bp, Artificial Sequence
  Synthetic polynucleotide
tgacttggacgaggtt

SEQ ID NO: 7386 - DNA, 16 bp, Artificial Sequence
  Synthetic polynucleotide
tcactgggcgctatac

SEQ ID NO: 7387 - DNA, 16 bp, Artificial Sequence
  Synthetic polynucleotide
aggaaactcgaggggc

SEQ ID NO: 7388 - DNA, 16 bp, Artificial Sequence
  Synthetic polynucleotide
tccctgtctgtcgagc

SEQ ID NO: 7389 - DNA, 16 bp, Artificial Sequence
  Synthetic polynucleotide
ccagcgaccacttctg

SEQ ID NO: 7390 - DNA, 16 bp, Artificial Sequence
  Synthetic polynucleotide
gagaaagatgcggtgg

SEQ ID NO: 7391 - DNA, 16 bp, Artificial Sequence
  Synthetic polynucleotide
cagtagttgtgattag

SEQ ID NO: 7392 - DNA, 16 bp, Artificial Sequence
  Synthetic polynucleotide
cttgggggtgatatac

SEQ ID NO: 7393 - DNA, 16 bp, Artificial Sequence
  Synthetic polynucleotide
ctcactaaactccttc

SEQ ID NO: 7394 - DNA, 16 bp, Artificial Sequence
  Synthetic polynucleotide
taatgtgactaagcgt

SEQ ID NO: 7395 - DNA, 16 bp, Artificial Sequence
  Synthetic polynucleotide
taactccaaaggaaac

SEQ ID NO: 7396 - DNA, 16 bp, Artificial Sequence
  Synthetic polynucleotide
cagctatcccatattc

SEQ ID NO: 7397 - DNA, 16 bp, Artificial Sequence
  Synthetic polynucleotide
gatgtaagcggacatc

SEQ ID NO: 7398 - DNA, 16 bp, Artificial Sequence
  Synthetic polynucleotide
tatgcgcccgatatcc

SEQ ID NO: 7399 - DNA, 16 bp, Artificial Sequence
  Synthetic polynucleotide
gttcaaactagggggc

SEQ ID NO: 7400 - DNA, 16 bp, Artificial Sequence
  Synthetic polynucleotide
ttctgaccaaagctca

SEQ ID NO: 7401 - DNA, 16 bp, Artificial Sequence
  Synthetic polynucleotide
tgagaattgtaaacag

SEQ ID NO: 7402 - DNA, 16 bp, Artificial Sequence
  Synthetic polynucleotide
gaacagcttagagcag

SEQ ID NO: 7403 - DNA, 16 bp, Artificial Sequence
  Synthetic polynucleotide
tcaagttcggatacgc

SEQ ID NO: 7404 - DNA, 16 bp, Artificial Sequence
  Synthetic polynucleotide
tacctatggacgggga

SEQ ID NO: 7405 - DNA, 16 bp, Artificial Sequence
  Synthetic polynucleotide
tatgcgacaccatgat

SEQ ID NO: 7406 - DNA, 16 bp, Artificial Sequence
  Synthetic polynucleotide
ccggatgagttatgaa

SEQ ID NO: 7407 - DNA, 16 bp, Artificial Sequence
  Synthetic polynucleotide
gatcgtcattgggata

SEQ ID NO: 7408 - DNA, 16 bp, Artificial Sequence
  Synthetic polynucleotide
tacaatctcgaagtaa

SEQ ID NO: 7409 - DNA, 16 bp, Artificial Sequence
  Synthetic polynucleotide
agcatagcaccctgcg

SEQ ID NO: 7410 - DNA, 16 bp, Artificial Sequence
  Synthetic polynucleotide
aagatagggtcacagc

SEQ ID NO: 7411 - DNA, 16 bp, Artificial Sequence
  Synthetic polynucleotide
agtaatacctctacct

SEQ ID NO: 7412 - DNA, 16 bp, Artificial Sequence
  Synthetic polynucleotide
tgttggacgtaagcgt

SEQ ID NO: 7413 - DNA, 16 bp, Artificial Sequence
  Synthetic polynucleotide
gaaataacgaccagaa

SEQ ID NO: 7414 - DNA, 16 bp, Artificial Sequence
  Synthetic polynucleotide
agcacgaggattatca

SEQ ID NO: 7415 - DNA, 16 bp, Artificial Sequence
  Synthetic polynucleotide
cgtgtacctcgaaata

SEQ ID NO: 7416 - DNA, 16 bp, Artificial Sequence
  Synthetic polynucleotide
atcgttagtttctcga

SEQ ID NO: 7417 - DNA, 16 bp, Artificial Sequence
  Synthetic polynucleotide
ctgttccgaaacaggc

SEQ ID NO: 7418 - DNA, 16 bp, Artificial Sequence
  Synthetic polynucleotide
agcggtagcctcccac

SEQ ID NO: 7419 - DNA, 16 bp, Artificial Sequence
  Synthetic polynucleotide
ttaacctatgccttgg

SEQ ID NO: 7420 - DNA, 16 bp, Artificial Sequence
  Synthetic polynucleotide
taactgattttctcct

SEQ ID NO: 7421 - DNA, 16 bp, Artificial Sequence
  Synthetic polynucleotide
ggttccgctagctgat

SEQ ID NO: 7422 - DNA, 16 bp, Artificial Sequence
  Synthetic polynucleotide
ctatggtccttaatat

SEQ ID NO: 7423 - DNA, 16 bp, Artificial Sequence
  Synthetic polynucleotide
gggagagggtgaaaca

SEQ ID NO: 7424 - DNA, 16 bp, Artificial Sequence
  Synthetic polynucleotide
ggccacctggctcggg

SEQ ID NO: 7425 - DNA, 16 bp, Artificial Sequence
  Synthetic polynucleotide
gccgcctcggttatac

SEQ ID NO: 7426 - DNA, 16 bp, Artificial Sequence
  Synthetic polynucleotide
tcgtcaagcctgcttt

SEQ ID NO: 7427 - DNA, 16 bp, Artificial Sequence
  Synthetic polynucleotide
acgtgggagtgcccga

SEQ ID NO: 7428 - DNA, 16 bp, Artificial Sequence
  Synthetic polynucleotide
gcgtctgaggtatggt

SEQ ID NO: 7429 - DNA, 16 bp, Artificial Sequence
  Synthetic polynucleotide
ttacccactatgttgt

SEQ ID NO: 7430 - DNA, 16 bp, Artificial Sequence
  Synthetic polynucleotide
ctcaagtgctaacagt

SEQ ID NO: 7431 - DNA, 16 bp, Artificial Sequence
  Synthetic polynucleotide
actaattatccataac

SEQ ID NO: 7432 - DNA, 16 bp, Artificial Sequence
  Synthetic polynucleotide
tgtgcacgtcagggat

SEQ ID NO: 7433 - DNA, 16 bp, Artificial Sequence
  Synthetic polynucleotide
tctcaccggtggccgt

SEQ ID NO: 7434 - DNA, 16 bp, Artificial Sequence
  Synthetic polynucleotide
tgctacatcagtttct

SEQ ID NO: 7435 - DNA, 16 bp, Artificial Sequence
  Synthetic polynucleotide
ttgcactcctggggaa

SEQ ID NO: 7436 - DNA, 16 bp, Artificial Sequence
  Synthetic polynucleotide
actatacttacgcact

SEQ ID NO: 7437 - DNA, 16 bp, Artificial Sequence
  Synthetic polynucleotide
ggtttggagggattag

SEQ ID NO: 7438 - DNA, 16 bp, Artificial Sequence
  Synthetic polynucleotide
gcaattgctaggttgc

SEQ ID NO: 7439 - DNA, 16 bp, Artificial Sequence
  Synthetic polynucleotide
attgtaggcacaattt

SEQ ID NO: 7440 - DNA, 16 bp, Artificial Sequence
  Synthetic polynucleotide
ttgattcgatcacata

SEQ ID NO: 7441 - DNA, 16 bp, Artificial Sequence
  Synthetic polynucleotide
catgggcaataaagct

SEQ ID NO: 7442 - DNA, 16 bp, Artificial Sequence
  Synthetic polynucleotide
gtagcctgaggcgcgc

SEQ ID NO: 7443 - DNA, 16 bp, Artificial Sequence
  Synthetic polynucleotide
agctgcaccgtgtcac

SEQ ID NO: 7444 - DNA, 16 bp, Artificial Sequence
  Synthetic polynucleotide
cttgatattgagggac

SEQ ID NO: 7445 - DNA, 16 bp, Artificial Sequence
  Synthetic polynucleotide
acctcgtcattcggat

SEQ ID NO: 7446 - DNA, 16 bp, Artificial Sequence
  Synthetic polynucleotide
aaaccatactgagggc

SEQ ID NO: 7447 - DNA, 16 bp, Artificial Sequence
  Synthetic polynucleotide
agtgggcgagatcggc

SEQ ID NO: 7448 - DNA, 16 bp, Artificial Sequence
  Synthetic polynucleotide
taatcattagtgctcc

SEQ ID NO: 7449 - DNA, 16 bp, Artificial Sequence
  Synthetic polynucleotide
cttagttagttcatag

SEQ ID NO: 7450 - DNA, 16 bp, Artificial Sequence
  Synthetic polynucleotide
ttcattaggggcggaa

SEQ ID NO: 7451 - DNA, 16 bp, Artificial Sequence
  Synthetic polynucleotide
atgggctggtgcccca

SEQ ID NO: 7452 - DNA, 16 bp, Artificial Sequence
  Synthetic polynucleotide
cgtacagtaaccaacc

SEQ ID NO: 7453 - DNA, 16 bp, Artificial Sequence
  Synthetic polynucleotide
ggtgtacctgtgggta

SEQ ID NO: 7454 - DNA, 16 bp, Artificial Sequence
  Synthetic polynucleotide
gggccgagcgctgggc

SEQ ID NO: 7455 - DNA, 16 bp, Artificial Sequence
  Synthetic polynucleotide
ttacatgtgcaagtga

SEQ ID NO: 7456 - DNA, 16 bp, Artificial Sequence
  Synthetic polynucleotide
aatatatgacttggtc

SEQ ID NO: 7457 - DNA, 16 bp, Artificial Sequence
  Synthetic polynucleotide
gaccagatctgctaga

SEQ ID NO: 7458 - DNA, 16 bp, Artificial Sequence
  Synthetic polynucleotide
aaccaccaacatcctc

SEQ ID NO: 7459 - DNA, 16 bp, Artificial Sequence
  Synthetic polynucleotide
cttgacacctttcaat

SEQ ID NO: 7460 - DNA, 16 bp, Artificial Sequence
  Synthetic polynucleotide
ttttagtaaacaccca

SEQ ID NO: 7461 - DNA, 16 bp, Artificial Sequence
  Synthetic polynucleotide
acagagctgaacttcc

SEQ ID NO: 7462 - DNA, 16 bp, Artificial Sequence
  Synthetic polynucleotide
catggtcgttctactg

SEQ ID NO: 7463 - DNA, 16 bp, Artificial Sequence
  Synthetic polynucleotide
tcgtatgatcatagga

SEQ ID NO: 7464 - DNA, 16 bp, Artificial Sequence
  Synthetic polynucleotide
tcaaactaaatacagc

SEQ ID NO: 7465 - DNA, 16 bp, Artificial Sequence
  Synthetic polynucleotide
gtaccgccagttcttg

SEQ ID NO: 7466 - DNA, 16 bp, Artificial Sequence
  Synthetic polynucleotide
tccttattggcgatcg

SEQ ID NO: 7467 - DNA, 16 bp, Artificial Sequence
  Synthetic polynucleotide
tgcattccaatgtttg

SEQ ID NO: 7468 - DNA, 16 bp, Artificial Sequence
  Synthetic polynucleotide
atggccgcgtggctta

SEQ ID NO: 7469 - DNA, 16 bp, Artificial Sequence
  Synthetic polynucleotide
aaccacataaagtcgt

SEQ ID NO: 7470 - DNA, 16 bp, Artificial Sequence
  Synthetic polynucleotide
ccgcctccggtagtca

SEQ ID NO: 7471 - DNA, 16 bp, Artificial Sequence
  Synthetic polynucleotide
cagaaagtctataccc

SEQ ID NO: 7472 - DNA, 16 bp, Artificial Sequence
  Synthetic polynucleotide
gacaaaaacagatttg

SEQ ID NO: 7473 - DNA, 16 bp, Artificial Sequence
  Synthetic polynucleotide
tatactcttgcggggg

SEQ ID NO: 7474 - DNA, 16 bp, Artificial Sequence
  Synthetic polynucleotide
ggtcgagcgctccact

SEQ ID NO: 7475 - DNA, 16 bp, Artificial Sequence
  Synthetic polynucleotide
gtagtggccggccatc

SEQ ID NO: 7476 - DNA, 16 bp, Artificial Sequence
  Synthetic polynucleotide
gtggactagaaagcgc

SEQ ID NO: 7477 - DNA, 16 bp, Artificial Sequence
  Synthetic polynucleotide
cggcaatctgaatatc

SEQ ID NO: 7478 - DNA, 16 bp, Artificial Sequence
  Synthetic polynucleotide
gctacctccgatacgc

SEQ ID NO: 7479 - DNA, 16 bp, Artificial Sequence
  Synthetic polynucleotide
gaaccagaaccattta

SEQ ID NO: 7480 - DNA, 16 bp, Artificial Sequence
  Synthetic polynucleotide
agagtaggggcagtgc

SEQ ID NO: 7481 - DNA, 16 bp, Artificial Sequence
  Synthetic polynucleotide
tcagccaaacagtggg

SEQ ID NO: 7482 - DNA, 16 bp, Artificial Sequence
  Synthetic polynucleotide
acatctcggaaaggtg

SEQ ID NO: 7483 - DNA, 16 bp, Artificial Sequence
  Synthetic polynucleotide
tcccaagtgcaagtaa

SEQ ID NO: 7484 - DNA, 16 bp, Artificial Sequence
  Synthetic polynucleotide
aaaaggaattatgaga

SEQ ID NO: 7485 - DNA, 16 bp, Artificial Sequence
  Synthetic polynucleotide
tcatgtgggatcctaa

SEQ ID NO: 7486 - DNA, 16 bp, Artificial Sequence
  Synthetic polynucleotide
agtttctggtagacct

SEQ ID NO: 7487 - DNA, 16 bp, Artificial Sequence
  Synthetic polynucleotide
cgtaggctagagcggt

SEQ ID NO: 7488 - DNA, 16 bp, Artificial Sequence
  Synthetic polynucleotide
gatatccacggtacat

SEQ ID NO: 7489 - DNA, 16 bp, Artificial Sequence
  Synthetic polynucleotide
tcgtttactgcacgga

SEQ ID NO: 7490 - DNA, 16 bp, Artificial Sequence
  Synthetic polynucleotide
acgagagtgctggcat

SEQ ID NO: 7491 - DNA, 16 bp, Artificial Sequence
  Synthetic polynucleotide
aagcaagagaaaccta

SEQ ID NO: 7492 - DNA, 16 bp, Artificial Sequence
  Synthetic polynucleotide
acttggggactaagat

SEQ ID NO: 7493 - DNA, 16 bp, Artificial Sequence
  Synthetic polynucleotide
cgttgcgaattttcgc

SEQ ID NO: 7494 - DNA, 16 bp, Artificial Sequence
  Synthetic polynucleotide
gcgattcgcatgtagc

SEQ ID NO: 7495 - DNA, 16 bp, Artificial Sequence
  Synthetic polynucleotide
cgaacgagatcgtcct

SEQ ID NO: 7496 - DNA, 16 bp, Artificial Sequence
  Synthetic polynucleotide
agacgacggatctcct

SEQ ID NO: 7497 - DNA, 16 bp, Artificial Sequence
  Synthetic polynucleotide
gcatgccggtagcacc

SEQ ID NO: 7498 - DNA, 16 bp, Artificial Sequence
  Synthetic polynucleotide
gtcaaatatgcgtgct

SEQ ID NO: 7499 - DNA, 16 bp, Artificial Sequence
  Synthetic polynucleotide
tttaacgctttagacc

SEQ ID NO: 7500 - DNA, 16 bp, Artificial Sequence
  Synthetic polynucleotide
cagcttgacgcaagac

SEQ ID NO: 7501 - DNA, 16 bp, Artificial Sequence
  Synthetic polynucleotide
gctaatcactgggcag

SEQ ID NO: 7502 - DNA, 16 bp, Artificial Sequence
  Synthetic polynucleotide
ggtcctaggttgcaga

SEQ ID NO: 7503 - DNA, 16 bp, Artificial Sequence
  Synthetic polynucleotide
aacctaccccctaagc

SEQ ID NO: 7504 - DNA, 16 bp, Artificial Sequence
  Synthetic polynucleotide
agcgtagtaagggtta

SEQ ID NO: 7505 - DNA, 16 bp, Artificial Sequence
  Synthetic polynucleotide
caagttcctgcggcgg

SEQ ID NO: 7506 - DNA, 16 bp, Artificial Sequence
  Synthetic polynucleotide
ctgtacgaatgagtcc

SEQ ID NO: 7507 - DNA, 16 bp, Artificial Sequence
  Synthetic polynucleotide
ggccttgacatgacat

SEQ ID NO: 7508 - DNA, 16 bp, Artificial Sequence
  Synthetic polynucleotide
tctcccacccgtccaa

SEQ ID NO: 7509 - DNA, 16 bp, Artificial Sequence
  Synthetic polynucleotide
caccagcaggatgtcg

SEQ ID NO: 7510 - DNA, 16 bp, Artificial Sequence
  Synthetic polynucleotide
agcccacaacttgaca

SEQ ID NO: 7511 - DNA, 16 bp, Artificial Sequence
  Synthetic polynucleotide
gtagtacagtatcttt

SEQ ID NO: 7512 - DNA, 16 bp, Artificial Sequence
  Synthetic polynucleotide
tttcatggcggcgatg

SEQ ID NO: 7513 - DNA, 16 bp, Artificial Sequence
  Synthetic polynucleotide
tgcgtacggcttttat

SEQ ID NO: 7514 - DNA, 16 bp, Artificial Sequence
  Synthetic polynucleotide
atagcgtagaccggac

SEQ ID NO: 7515 - DNA, 16 bp, Artificial Sequence
  Synthetic polynucleotide
agagtcgttatgcccc

SEQ ID NO: 7516 - DNA, 16 bp, Artificial Sequence
  Synthetic polynucleotide
ccggttctgctagagt

SEQ ID NO: 7517 - DNA, 16 bp, Artificial Sequence
  Synthetic polynucleotide
cgcgcttaccaagtaa

SEQ ID NO: 7518 - DNA, 16 bp, Artificial Sequence
  Synthetic polynucleotide
cgtatgtacgacgcga

SEQ ID NO: 7519 - DNA, 16 bp, Artificial Sequence
  Synthetic polynucleotide
tgcgagtgaacgggtg

SEQ ID NO: 7520 - DNA, 16 bp, Artificial Sequence
  Synthetic polynucleotide
gatgaatttcgttcgg

SEQ ID NO: 7521 - DNA, 16 bp, Artificial Sequence
  Synthetic polynucleotide
ggccaggcgatctaag

SEQ ID NO: 7522 - DNA, 16 bp, Artificial Sequence
  Synthetic polynucleotide
tctggcgcgtgaggac

SEQ ID NO: 7523 - DNA, 16 bp, Artificial Sequence
  Synthetic polynucleotide
acgtaagttgaagtag

SEQ ID NO: 7524 - DNA, 16 bp, Artificial Sequence
  Synthetic polynucleotide
gaagctttttctagcc

SEQ ID NO: 7525 - DNA, 16 bp, Artificial Sequence
  Synthetic polynucleotide
atagcatcgacactac

SEQ ID NO: 7526 - DNA, 16 bp, Artificial Sequence
  Synthetic polynucleotide
gacctgcttttcgaca

SEQ ID NO: 7527 - DNA, 16 bp, Artificial Sequence
  Synthetic polynucleotide
cggactgcattctgga

SEQ ID NO: 7528 - DNA, 16 bp, Artificial Sequence
  Synthetic polynucleotide
cagtaactgcattaac

SEQ ID NO: 7529 - DNA, 16 bp, Artificial Sequence
  Synthetic polynucleotide
tacgtgctcccaacat

SEQ ID NO: 7530 - DNA, 16 bp, Artificial Sequence
  Synthetic polynucleotide
aagtgacgtcctcagc

SEQ ID NO: 7531 - DNA, 16 bp, Artificial Sequence
  Synthetic polynucleotide
agttgaaaattatctc

SEQ ID NO: 7532 - DNA, 16 bp, Artificial Sequence
  Synthetic polynucleotide
gataagcagaaggacc

SEQ ID NO: 7533 - DNA, 16 bp, Artificial Sequence
  Synthetic polynucleotide
tgtataactggcaaga

SEQ ID NO: 7534 - DNA, 16 bp, Artificial Sequence
  Synthetic polynucleotide
gacaaggccgcttcag

SEQ ID NO: 7535 - DNA, 16 bp, Artificial Sequence
  Synthetic polynucleotide
aaaggatagccggacc

SEQ ID NO: 7536 - DNA, 16 bp, Artificial Sequence
  Synthetic polynucleotide
gtattaatgccgcgcc

SEQ ID NO: 7537 - DNA, 16 bp, Artificial Sequence
  Synthetic polynucleotide
aacggtttcccggacc

SEQ ID NO: 7538 - DNA, 16 bp, Artificial Sequence
  Synthetic polynucleotide
tagtgtctatcaagtc

SEQ ID NO: 7539 - DNA, 16 bp, Artificial Sequence
  Synthetic polynucleotide
tattctatgaaaccat

SEQ ID NO: 7540 - DNA, 16 bp, Artificial Sequence
  Synthetic polynucleotide
tctcgggtcgagcggg

SEQ ID NO: 7541 - DNA, 16 bp, Artificial Sequence
  Synthetic polynucleotide
tcactgttgtgaccta

SEQ ID NO: 7542 - DNA, 16 bp, Artificial Sequence
  Synthetic polynucleotide
cgagaagcgtatagat

SEQ ID NO: 7543 - DNA, 16 bp, Artificial Sequence
  Synthetic polynucleotide
gttccgcgcgaatagc

SEQ ID NO: 7544 - DNA, 16 bp, Artificial Sequence
  Synthetic polynucleotide
tcacaggcgaactacg

SEQ ID NO: 7545 - DNA, 16 bp, Artificial Sequence
  Synthetic polynucleotide
tatgaattggtttaaa

SEQ ID NO: 7546 - DNA, 16 bp, Artificial Sequence
  Synthetic polynucleotide
cgctcctcgggaatta

SEQ ID NO: 7547 - DNA, 16 bp, Artificial Sequence
  Synthetic polynucleotide
atacgacaggtggcaa

SEQ ID NO: 7548 - DNA, 16 bp, Artificial Sequence
  Synthetic polynucleotide
accacctccgatgtca

SEQ ID NO: 7549 - DNA, 16 bp, Artificial Sequence
  Synthetic polynucleotide
gcgccgcatacccatt

SEQ ID NO: 7550 - DNA, 16 bp, Artificial Sequence
  Synthetic polynucleotide
cactgtgaatttccac

SEQ ID NO: 7551 - DNA, 16 bp, Artificial Sequence
  Synthetic polynucleotide
accgaggattcgcagg

SEQ ID NO: 7552 - DNA, 16 bp, Artificial Sequence
  Synthetic polynucleotide
tccatgggattcacca

SEQ ID NO: 7553 - DNA, 16 bp, Artificial Sequence
  Synthetic polynucleotide
agctcgtatacaccct

SEQ ID NO: 7554 - DNA, 16 bp, Artificial Sequence
  Synthetic polynucleotide
gattctccatggcagc

SEQ ID NO: 7555 - DNA, 16 bp, Artificial Sequence
  Synthetic polynucleotide
gcttcggtacaggtct

SEQ ID NO: 7556 - DNA, 16 bp, Artificial Sequence
  Synthetic polynucleotide
gaactggtagatcacc

SEQ ID NO: 7557 - DNA, 16 bp, Artificial Sequence
  Synthetic polynucleotide
attagtgtacccagca

SEQ ID NO: 7558 - DNA, 16 bp, Artificial Sequence
  Synthetic polynucleotide
gttcggctcccttgtg

SEQ ID NO: 7559 - DNA, 16 bp, Artificial Sequence
  Synthetic polynucleotide
tcgtcgtgtaatgctg

SEQ ID NO: 7560 - DNA, 16 bp, Artificial Sequence
  Synthetic polynucleotide
ttccggggtaaatcaa

SEQ ID NO: 7561 - DNA, 16 bp, Artificial Sequence
  Synthetic polynucleotide
acgctctgttccaaac

SEQ ID NO: 7562 - DNA, 16 bp, Artificial Sequence
  Synthetic polynucleotide
tttagagcccggccgt

SEQ ID NO: 7563 - DNA, 16 bp, Artificial Sequence
  Synthetic polynucleotide
acccaatcatacgagc

SEQ ID NO: 7564 - DNA, 16 bp, Artificial Sequence
  Synthetic polynucleotide
gtggagggaagttatt

SEQ ID NO: 7565 - DNA, 16 bp, Artificial Sequence
  Synthetic polynucleotide
ctactggcgttttcat

SEQ ID NO: 7566 - DNA, 16 bp, Artificial Sequence
  Synthetic polynucleotide
atatcagagagcacag

SEQ ID NO: 7567 - DNA, 16 bp, Artificial Sequence
  Synthetic polynucleotide
taattcggagcccggc

SEQ ID NO: 7568 - DNA, 16 bp, Artificial Sequence
  Synthetic polynucleotide
gtattatcgcgtcaat

SEQ ID NO: 7569 - DNA, 16 bp, Artificial Sequence
  Synthetic polynucleotide
tcatatggacacacca

SEQ ID NO: 7570 - DNA, 16 bp, Artificial Sequence
  Synthetic polynucleotide
gattacggcggcttag

SEQ ID NO: 7571 - DNA, 16 bp, Artificial Sequence
  Synthetic polynucleotide
gggaattgagtacaag

SEQ ID NO: 7572 - DNA, 16 bp, Artificial Sequence
  Synthetic polynucleotide
tgacgaagaataccgt

SEQ ID NO: 7573 - DNA, 16 bp, Artificial Sequence
  Synthetic polynucleotide
ccatcagatggagctg

SEQ ID NO: 7574 - DNA, 16 bp, Artificial Sequence
  Synthetic polynucleotide
tcaggcttctccgtca

SEQ ID NO: 7575 - DNA, 16 bp, Artificial Sequence
  Synthetic polynucleotide
aaatgttggctgagat

SEQ ID NO: 7576 - DNA, 16 bp, Artificial Sequence
  Synthetic polynucleotide
tgattggtttagtgta

SEQ ID NO: 7577 - DNA, 16 bp, Artificial Sequence
  Synthetic polynucleotide
tagcgagtaagagata

SEQ ID NO: 7578 - DNA, 16 bp, Artificial Sequence
  Synthetic polynucleotide
tgtgggaggatcatta

SEQ ID NO: 7579 - DNA, 16 bp, Artificial Sequence
  Synthetic polynucleotide
caggatcaaagttgac

SEQ ID NO: 7580 - DNA, 16 bp, Artificial Sequence
  Synthetic polynucleotide
tagcagaataatttgc

SEQ ID NO: 7581 - DNA, 16 bp, Artificial Sequence
  Synthetic polynucleotide
atccgaataaggtacg

SEQ ID NO: 7582 - DNA, 16 bp, Artificial Sequence
  Synthetic polynucleotide
caattactatttgtac

SEQ ID NO: 7583 - DNA, 16 bp, Artificial Sequence
  Synthetic polynucleotide
cgaaaacaagggcata

SEQ ID NO: 7584 - DNA, 16 bp, Artificial Sequence
  Synthetic polynucleotide
cagtaacgaaaagcga

SEQ ID NO: 7585 - DNA, 16 bp, Artificial Sequence
  Synthetic polynucleotide
acgagccaccacctag

SEQ ID NO: 7586 - DNA, 16 bp, Artificial Sequence
  Synthetic polynucleotide
cacctcctgttagggt

SEQ ID NO: 7587 - DNA, 16 bp, Artificial Sequence
  Synthetic polynucleotide
gacacccgggatgggt

SEQ ID NO: 7588 - DNA, 16 bp, Artificial Sequence
  Synthetic polynucleotide
tgttcatcggtcaccc

SEQ ID NO: 7589 - DNA, 16 bp, Artificial Sequence
  Synthetic polynucleotide
cagttttcgcttgagg

SEQ ID NO: 7590 - DNA, 16 bp, Artificial Sequence
  Synthetic polynucleotide
aatagtccaagaaatg

SEQ ID NO: 7591 - DNA, 16 bp, Artificial Sequence
  Synthetic polynucleotide
catgataaaagttgtg

SEQ ID NO: 7592 - DNA, 16 bp, Artificial Sequence
  Synthetic polynucleotide
ccgcactggaatctga

SEQ ID NO: 7593 - DNA, 16 bp, Artificial Sequence
  Synthetic polynucleotide
agatgcaccggttctc

SEQ ID NO: 7594 - DNA, 16 bp, Artificial Sequence
  Synthetic polynucleotide
gagacactcatttact

SEQ ID NO: 7595 - DNA, 16 bp, Artificial Sequence
  Synthetic polynucleotide
gctcggtagaccatgt

SEQ ID NO: 7596 - DNA, 16 bp, Artificial Sequence
  Synthetic polynucleotide
ctccagtattgccatt

SEQ ID NO: 7597 - DNA, 16 bp, Artificial Sequence
  Synthetic polynucleotide
ttctaattaatacttt

SEQ ID NO: 7598 - DNA, 16 bp, Artificial Sequence
  Synthetic polynucleotide
taatataatgtccgcg

SEQ ID NO: 7599 - DNA, 16 bp, Artificial Sequence
  Synthetic polynucleotide
gatcagcgaattcgac

SEQ ID NO: 7600 - DNA, 16 bp, Artificial Sequence
  Synthetic polynucleotide
acaatggtatcttttg

SEQ ID NO: 7601 - DNA, 16 bp, Artificial Sequence
  Synthetic polynucleotide
aagcgcacgtaaaccg

SEQ ID NO: 7602 - DNA, 16 bp, Artificial Sequence
  Synthetic polynucleotide
cttgcctgggccaata

SEQ ID NO: 7603 - DNA, 16 bp, Artificial Sequence
  Synthetic polynucleotide
atataggtctgacacc

SEQ ID NO: 7604 - DNA, 16 bp, Artificial Sequence
  Synthetic polynucleotide
cagctcccaggtaagt

SEQ ID NO: 7605 - DNA, 16 bp, Artificial Sequence
  Synthetic polynucleotide
aatggtcgacaatatg

SEQ ID NO: 7606 - DNA, 16 bp, Artificial Sequence
  Synthetic polynucleotide
tattaagttttcgccg

SEQ ID NO: 7607 - DNA, 16 bp, Artificial Sequence
  Synthetic polynucleotide
cttctacctcttaatg

SEQ ID NO: 7608 - DNA, 16 bp, Artificial Sequence
  Synthetic polynucleotide
tataattcatcctgtg

SEQ ID NO: 7609 - DNA, 16 bp, Artificial Sequence
  Synthetic polynucleotide
catggaagcagagttc

SEQ ID NO: 7610 - DNA, 16 bp, Artificial Sequence
  Synthetic polynucleotide
ccatcggcaaaattga

SEQ ID NO: 7611 - DNA, 16 bp, Artificial Sequence
  Synthetic polynucleotide
gttaccgctataatta

SEQ ID NO: 7612 - DNA, 16 bp, Artificial Sequence
  Synthetic polynucleotide
agaacattcgggttcg

SEQ ID NO: 7613 - DNA, 16 bp, Artificial Sequence
  Synthetic polynucleotide
acgtggtctatgtgat

SEQ ID NO: 7614 - DNA, 16 bp, Artificial Sequence
  Synthetic polynucleotide
cgcctaggctaacctc

SEQ ID NO: 7615 - DNA, 16 bp, Artificial Sequence
  Synthetic polynucleotide
atgactccaggagagg

SEQ ID NO: 7616 - DNA, 16 bp, Artificial Sequence
  Synthetic polynucleotide
gtgagctcctacgtgg

SEQ ID NO: 7617 - DNA, 16 bp, Artificial Sequence
  Synthetic polynucleotide
aagtgttaatgccgag

SEQ ID NO: 7618 - DNA, 16 bp, Artificial Sequence
  Synthetic polynucleotide
atctaacttgattttt

SEQ ID NO: 7619 - DNA, 16 bp, Artificial Sequence
  Synthetic polynucleotide
attcagaatcgagacc

SEQ ID NO: 7620 - DNA, 16 bp, Artificial Sequence
  Synthetic polynucleotide
ttgctcttggacgtct

SEQ ID NO: 7621 - DNA, 16 bp, Artificial Sequence
  Synthetic polynucleotide
cattctatagcccgcg

SEQ ID NO: 7622 - DNA, 16 bp, Artificial Sequence
  Synthetic polynucleotide
gttactaggcgccttg

SEQ ID NO: 7623 - DNA, 16 bp, Artificial Sequence
  Synthetic polynucleotide
ctcctacgctcaatag

SEQ ID NO: 7624 - DNA, 16 bp, Artificial Sequence
  Synthetic polynucleotide
tgaacccttactatcg

SEQ ID NO: 7625 - DNA, 16 bp, Artificial Sequence
  Synthetic polynucleotide
cgacaggataggtcaa

SEQ ID NO: 7626 - DNA, 16 bp, Artificial Sequence
  Synthetic polynucleotide
aataaacgatacttaa

SEQ ID NO: 7627 - DNA, 16 bp, Artificial Sequence
  Synthetic polynucleotide
agctctagaggggaac

SEQ ID NO: 7628 - DNA, 16 bp, Artificial Sequence
  Synthetic polynucleotide
cgtagacttcacataa

SEQ ID NO: 7629 - DNA, 16 bp, Artificial Sequence
  Synthetic polynucleotide
aaaacactcggcgagt

SEQ ID NO: 7630 - DNA, 16 bp, Artificial Sequence
  Synthetic polynucleotide
gttctagggagcgggg

SEQ ID NO: 7631 - DNA, 16 bp, Artificial Sequence
  Synthetic polynucleotide
atggtacacccagcat

SEQ ID NO: 7632 - DNA, 16 bp, Artificial Sequence
  Synthetic polynucleotide
tccttcagtccgccta

SEQ ID NO: 7633 - DNA, 16 bp, Artificial Sequence
  Synthetic polynucleotide
ctcatgatctttgata

SEQ ID NO: 7634 - DNA, 16 bp, Artificial Sequence
  Synthetic polynucleotide
ttctcccaaatggata

SEQ ID NO: 7635 - DNA, 16 bp, Artificial Sequence
  Synthetic polynucleotide
gggcgtaaacaaaaaa

SEQ ID NO: 7636 - DNA, 16 bp, Artificial Sequence
  Synthetic polynucleotide
cttgcctatcgtgccc

SEQ ID NO: 7637 - DNA, 16 bp, Artificial Sequence
  Synthetic polynucleotide
tcatacagcattgtct

SEQ ID NO: 7638 - DNA, 16 bp, Artificial Sequence
  Synthetic polynucleotide
accacctatgttctta

SEQ ID NO: 7639 - DNA, 16 bp, Artificial Sequence
  Synthetic polynucleotide
tgctgttaacatagat

SEQ ID NO: 7640 - DNA, 16 bp, Artificial Sequence
  Synthetic polynucleotide
cgtcgggcgaccttcg

SEQ ID NO: 7641 - DNA, 16 bp, Artificial Sequence
  Synthetic polynucleotide
taaggtggggccgacc

SEQ ID NO: 7642 - DNA, 16 bp, Artificial Sequence
  Synthetic polynucleotide
accgaccaaggcgcta

SEQ ID NO: 7643 - DNA, 16 bp, Artificial Sequence
  Synthetic polynucleotide
tagggtatactcgtaa

SEQ ID NO: 7644 - DNA, 16 bp, Artificial Sequence
  Synthetic polynucleotide
gcgatatctgaatgcg

SEQ ID NO: 7645 - DNA, 16 bp, Artificial Sequence
  Synthetic polynucleotide
taatacgaaacgacaa

SEQ ID NO: 7646 - DNA, 16 bp, Artificial Sequence
  Synthetic polynucleotide
aaaataccttcgccgg

SEQ ID NO: 7647 - DNA, 16 bp, Artificial Sequence
  Synthetic polynucleotide
tccgtccgttggagcc

SEQ ID NO: 7648 - DNA, 16 bp, Artificial Sequence
  Synthetic polynucleotide
cacgaaccaacgcatc

SEQ ID NO: 7649 - DNA, 16 bp, Artificial Sequence
  Synthetic polynucleotide
accattaccggaggcg

SEQ ID NO: 7650 - DNA, 16 bp, Artificial Sequence
  Synthetic polynucleotide
cattaggtctattata

SEQ ID NO: 7651 - DNA, 16 bp, Artificial Sequence
  Synthetic polynucleotide
tatcgttctataaaat

SEQ ID NO: 7652 - DNA, 16 bp, Artificial Sequence
  Synthetic polynucleotide
ggcactgtcacggcgc

SEQ ID NO: 7653 - DNA, 16 bp, Artificial Sequence
  Synthetic polynucleotide
atatcatctacaatgt

SEQ ID NO: 7654 - DNA, 16 bp, Artificial Sequence
  Synthetic polynucleotide
gtctgacccttcacat

SEQ ID NO: 7655 - DNA, 16 bp, Artificial Sequence
  Synthetic polynucleotide
taatatggggattacc

SEQ ID NO: 7656 - DNA, 16 bp, Artificial Sequence
  Synthetic polynucleotide
cttcaataagttgtag

SEQ ID NO: 7657 - DNA, 16 bp, Artificial Sequence
  Synthetic polynucleotide
gcatcagctggcaggt

SEQ ID NO: 7658 - DNA, 16 bp, Artificial Sequence
  Synthetic polynucleotide
gccatcctacccgctt

SEQ ID NO: 7659 - DNA, 16 bp, Artificial Sequence
  Synthetic polynucleotide
tctcatgcgaagcagg

SEQ ID NO: 7660 - DNA, 16 bp, Artificial Sequence
  Synthetic polynucleotide
atgtgtaatggtgggc

SEQ ID NO: 7661 - DNA, 16 bp, Artificial Sequence
  Synthetic polynucleotide
ggacgatatctgcgcc

SEQ ID NO: 7662 - DNA, 16 bp, Artificial Sequence
  Synthetic polynucleotide
agcgccacgtccccaa

SEQ ID NO: 7663 - DNA, 16 bp, Artificial Sequence
  Synthetic polynucleotide
ttgtcgggacctgtca

SEQ ID NO: 7664 - DNA, 16 bp, Artificial Sequence
  Synthetic polynucleotide
ttggagtgatgaacaa

SEQ ID NO: 7665 - DNA, 16 bp, Artificial Sequence
  Synthetic polynucleotide
cctgggtcctgctgcc

SEQ ID NO: 7666 - DNA, 16 bp, Artificial Sequence
  Synthetic polynucleotide
gccctttggggttcac

SEQ ID NO: 7667 - DNA, 16 bp, Artificial Sequence
  Synthetic polynucleotide
gcccgcgcataaccta

SEQ ID NO: 7668 - DNA, 16 bp, Artificial Sequence
  Synthetic polynucleotide
agtaatgtctagtgcc

SEQ ID NO: 7669 - DNA, 16 bp, Artificial Sequence
  Synthetic polynucleotide
gtatgtgaaagagtca

SEQ ID NO: 7670 - DNA, 16 bp, Artificial Sequence
  Synthetic polynucleotide
agcgtaaagtcttgac

SEQ ID NO: 7671 - DNA, 16 bp, Artificial Sequence
  Synthetic polynucleotide
gtattccatccagctg

SEQ ID NO: 7672 - DNA, 16 bp, Artificial Sequence
  Synthetic polynucleotide
acggtatggaaagaag

SEQ ID NO: 7673 - DNA, 16 bp, Artificial Sequence
  Synthetic polynucleotide
cgaaggggctcgagtc

SEQ ID NO: 7674 - DNA, 16 bp, Artificial Sequence
  Synthetic polynucleotide
tacagcagagctacgc

SEQ ID NO: 7675 - DNA, 16 bp, Artificial Sequence
  Synthetic polynucleotide
gtcccacgtctttaaa

SEQ ID NO: 7676 - DNA, 16 bp, Artificial Sequence
  Synthetic polynucleotide
tgtcccgtgttagggc

SEQ ID NO: 7677 - DNA, 16 bp, Artificial Sequence
  Synthetic polynucleotide
tcgcatctcgtggaat

SEQ ID NO: 7678 - DNA, 16 bp, Artificial Sequence
  Synthetic polynucleotide
ccattcagttcacagg

SEQ ID NO: 7679 - DNA, 16 bp, Artificial Sequence
  Synthetic polynucleotide
cccttagccgtacaaa

SEQ ID NO: 7680 - DNA, 16 bp, Artificial Sequence
  Synthetic polynucleotide
gcgttactgacccgct

SEQ ID NO: 7681 - DNA, 16 bp, Artificial Sequence
  Synthetic polynucleotide
gcaggtaaatgcaaaa

SEQ ID NO: 7682 - DNA, 16 bp, Artificial Sequence
  Synthetic polynucleotide
ctatgtctttctgagg

SEQ ID NO: 7683 - DNA, 16 bp, Artificial Sequence
  Synthetic polynucleotide
aggagcagtttgggtc

SEQ ID NO: 7684 - DNA, 16 bp, Artificial Sequence
  Synthetic polynucleotide
tacggcaccgaggcct

SEQ ID NO: 7685 - DNA, 16 bp, Artificial Sequence
  Synthetic polynucleotide
aatccgatgaccctaa

SEQ ID NO: 7686 - DNA, 16 bp, Artificial Sequence
  Synthetic polynucleotide
gagtccccgaagaata

SEQ ID NO: 7687 - DNA, 16 bp, Artificial Sequence
  Synthetic polynucleotide
ggatattctccgccgg

SEQ ID NO: 7688 - DNA, 16 bp, Artificial Sequence
  Synthetic polynucleotide
caagtaagcagggcgt

SEQ ID NO: 7689 - DNA, 16 bp, Artificial Sequence
  Synthetic polynucleotide
aaaagcagtcaaccgg

SEQ ID NO: 7690 - DNA, 16 bp, Artificial Sequence
  Synthetic polynucleotide
cgacgagtaacggcat

SEQ ID NO: 7691 - DNA, 16 bp, Artificial Sequence
  Synthetic polynucleotide
cttccgactttttata

SEQ ID NO: 7692 - DNA, 16 bp, Artificial Sequence
  Synthetic polynucleotide
actgctgggtgggcgc

SEQ ID NO: 7693 - DNA, 16 bp, Artificial Sequence
  Synthetic polynucleotide
cactgtgtggacgttt

SEQ ID NO: 7694 - DNA, 16 bp, Artificial Sequence
  Synthetic polynucleotide
gagcaatagaaattga

SEQ ID NO: 7695 - DNA, 16 bp, Artificial Sequence
  Synthetic polynucleotide
atcggctcaagacgta

SEQ ID NO: 7696 - DNA, 16 bp, Artificial Sequence
  Synthetic polynucleotide
gaatgagcgacgcacc

SEQ ID NO: 7697 - DNA, 16 bp, Artificial Sequence
  Synthetic polynucleotide
tgtccaagacaacatg

SEQ ID NO: 7698 - DNA, 16 bp, Artificial Sequence
  Synthetic polynucleotide
actacagttgaccggg

SEQ ID NO: 7699 - DNA, 16 bp, Artificial Sequence
  Synthetic polynucleotide
ggtgcaaaaagcgcaa

SEQ ID NO: 7700 - DNA, 16 bp, Artificial Sequence
  Synthetic polynucleotide
cggcgccgattgatca

SEQ ID NO: 7701 - DNA, 16 bp, Artificial Sequence
  Synthetic polynucleotide
atggttaagtataggt

SEQ ID NO: 7702 - DNA, 16 bp, Artificial Sequence
  Synthetic polynucleotide
ccttgttacgatggca

SEQ ID NO: 7703 - DNA, 16 bp, Artificial Sequence
  Synthetic polynucleotide
gcaatattcggacctt

SEQ ID NO: 7704 - DNA, 16 bp, Artificial Sequence
  Synthetic polynucleotide
ccaccgggtctgttcc

SEQ ID NO: 7705 - DNA, 16 bp, Artificial Sequence
  Synthetic polynucleotide
attgagcaggaatact

SEQ ID NO: 7706 - DNA, 16 bp, Artificial Sequence
  Synthetic polynucleotide
cagccttcaccgcggg

SEQ ID NO: 7707 - DNA, 16 bp, Artificial Sequence
  Synthetic polynucleotide
tctctatcgtacacat

SEQ ID NO: 7708 - DNA, 16 bp, Artificial Sequence
  Synthetic polynucleotide
ctctggctttaccaag

SEQ ID NO: 7709 - DNA, 16 bp, Artificial Sequence
  Synthetic polynucleotide
ccactaacgggacagt

SEQ ID NO: 7710 - DNA, 16 bp, Artificial Sequence
  Synthetic polynucleotide
cggaacatgcacgatg

SEQ ID NO: 7711 - DNA, 16 bp, Artificial Sequence
  Synthetic polynucleotide
tccgggatgggtgcca

SEQ ID NO: 7712 - DNA, 16 bp, Artificial Sequence
  Synthetic polynucleotide
ccgcaacctttacgtg

SEQ ID NO: 7713 - DNA, 16 bp, Artificial Sequence
  Synthetic polynucleotide
tttagggaatacaaga

SEQ ID NO: 7714 - DNA, 16 bp, Artificial Sequence
  Synthetic polynucleotide
ttcagcagccttactc

SEQ ID NO: 7715 - DNA, 16 bp, Artificial Sequence
  Synthetic polynucleotide
agcaatatcacggaca

SEQ ID NO: 7716 - DNA, 16 bp, Artificial Sequence
  Synthetic polynucleotide
ggaacaacgggtgtca

SEQ ID NO: 7717 - DNA, 16 bp, Artificial Sequence
  Synthetic polynucleotide
gtccaagtaagggcaa

SEQ ID NO: 7718 - DNA, 16 bp, Artificial Sequence
  Synthetic polynucleotide
tcgtatttgatgcccg

SEQ ID NO: 7719 - DNA, 16 bp, Artificial Sequence
  Synthetic polynucleotide
tgtgtatgctcacttt

SEQ ID NO: 7720 - DNA, 16 bp, Artificial Sequence
  Synthetic polynucleotide
tctggcgccggcttag

SEQ ID NO: 7721 - DNA, 16 bp, Artificial Sequence
  Synthetic polynucleotide
ccgtcacgcattgtgg

SEQ ID NO: 7722 - DNA, 16 bp, Artificial Sequence
  Synthetic polynucleotide
ttcgccgcgtcgtttt

SEQ ID NO: 7723 - DNA, 16 bp, Artificial Sequence
  Synthetic polynucleotide
ctcagtttaagattca

SEQ ID NO: 7724 - DNA, 16 bp, Artificial Sequence
  Synthetic polynucleotide
acaggacgatgttctc

SEQ ID NO: 7725 - DNA, 16 bp, Artificial Sequence
  Synthetic polynucleotide
acctcttcaggtctta

SEQ ID NO: 7726 - DNA, 16 bp, Artificial Sequence
  Synthetic polynucleotide
attttggcggaacggg

SEQ ID NO: 7727 - DNA, 16 bp, Artificial Sequence
  Synthetic polynucleotide
aagcatcgcgtccttg

SEQ ID NO: 7728 - DNA, 16 bp, Artificial Sequence
  Synthetic polynucleotide
gcatccgctcgcatgg

SEQ ID NO: 7729 - DNA, 16 bp, Artificial Sequence
  Synthetic polynucleotide
ttaagatgtgtggcaa

SEQ ID NO: 7730 - DNA, 16 bp, Artificial Sequence
  Synthetic polynucleotide
tacaatatagttatat

SEQ ID NO: 7731 - DNA, 16 bp, Artificial Sequence
  Synthetic polynucleotide
cctcatgtaacggtcg

SEQ ID NO: 7732 - DNA, 16 bp, Artificial Sequence
  Synthetic polynucleotide
tatccgcctatctcgc

SEQ ID NO: 7733 - DNA, 16 bp, Artificial Sequence
  Synthetic polynucleotide
agagttctaccagcca

SEQ ID NO: 7734 - DNA, 16 bp, Artificial Sequence
  Synthetic polynucleotide
agagagtcgcagccct

SEQ ID NO: 7735 - DNA, 16 bp, Artificial Sequence
  Synthetic polynucleotide
tcatcgtaggacatca

SEQ ID NO: 7736 - DNA, 16 bp, Artificial Sequence
  Synthetic polynucleotide
catctctgcctcgacg

SEQ ID NO: 7737 - DNA, 16 bp, Artificial Sequence
  Synthetic polynucleotide
tacgcgggcaatggag

SEQ ID NO: 7738 - DNA, 16 bp, Artificial Sequence
  Synthetic polynucleotide
gtgggcgcaaaccgtt

SEQ ID NO: 7739 - DNA, 16 bp, Artificial Sequence
  Synthetic polynucleotide
ttcaacttttaaacag

SEQ ID NO: 7740 - DNA, 16 bp, Artificial Sequence
  Synthetic polynucleotide
ttgaaggtttgaacca

SEQ ID NO: 7741 - DNA, 16 bp, Artificial Sequence
  Synthetic polynucleotide
ttccttgattcccagg

SEQ ID NO: 7742 - DNA, 16 bp, Artificial Sequence
  Synthetic polynucleotide
ttattgagacctatct

SEQ ID NO: 7743 - DNA, 16 bp, Artificial Sequence
  Synthetic polynucleotide
atcacgctctacagca

SEQ ID NO: 7744 - DNA, 16 bp, Artificial Sequence
  Synthetic polynucleotide
ccgtgatgagacttcg

SEQ ID NO: 7745 - DNA, 16 bp, Artificial Sequence
  Synthetic polynucleotide
tgcgttcgacgcctgc

SEQ ID NO: 7746 - DNA, 16 bp, Artificial Sequence
  Synthetic polynucleotide
ttccgtggccccgcaa

SEQ ID NO: 7747 - DNA, 16 bp, Artificial Sequence
  Synthetic polynucleotide
ccgcatcgctgagggg

SEQ ID NO: 7748 - DNA, 16 bp, Artificial Sequence
  Synthetic polynucleotide
gaggggatagcatacc

SEQ ID NO: 7749 - DNA, 16 bp, Artificial Sequence
  Synthetic polynucleotide
cagcacaaaccctcgc

SEQ ID NO: 7750 - DNA, 16 bp, Artificial Sequence
  Synthetic polynucleotide
gggtgatcggccgtta

SEQ ID NO: 7751 - DNA, 16 bp, Artificial Sequence
  Synthetic polynucleotide
gtcgtaatgtgctgtg

SEQ ID NO: 7752 - DNA, 16 bp, Artificial Sequence
  Synthetic polynucleotide
ttctatcgatctcctt

SEQ ID NO: 7753 - DNA, 16 bp, Artificial Sequence
  Synthetic polynucleotide
cgcaacaaaatgcaaa

SEQ ID NO: 7754 - DNA, 16 bp, Artificial Sequence
  Synthetic polynucleotide
accatgttgaaattgt

SEQ ID NO: 7755 - DNA, 16 bp, Artificial Sequence
  Synthetic polynucleotide
gctgccgacacgaggc

SEQ ID NO: 7756 - DNA, 16 bp, Artificial Sequence
  Synthetic polynucleotide
acacggcgtcagcgat

SEQ ID NO: 7757 - DNA, 16 bp, Artificial Sequence
  Synthetic polynucleotide
cgcatctacctagcaa

SEQ ID NO: 7758 - DNA, 16 bp, Artificial Sequence
  Synthetic polynucleotide
taagacaagtagaaca

SEQ ID NO: 7759 - DNA, 16 bp, Artificial Sequence
  Synthetic polynucleotide
ttgtgttgggtgtagt

SEQ ID NO: 7760 - DNA, 16 bp, Artificial Sequence
  Synthetic polynucleotide
ggattcatttaactac

SEQ ID NO: 7761 - DNA, 16 bp, Artificial Sequence
  Synthetic polynucleotide
cgatgttattacctaa

SEQ ID NO: 7762 - DNA, 16 bp, Artificial Sequence
  Synthetic polynucleotide
taccatgaggagcagg

SEQ ID NO: 7763 - DNA, 16 bp, Artificial Sequence
  Synthetic polynucleotide
gattgactaatacatt

SEQ ID NO: 7764 - DNA, 16 bp, Artificial Sequence
  Synthetic polynucleotide
tatgaatccagacacg

SEQ ID NO: 7765 - DNA, 16 bp, Artificial Sequence
  Synthetic polynucleotide
aggtacactccgggga

SEQ ID NO: 7766 - DNA, 16 bp, Artificial Sequence
  Synthetic polynucleotide
gtagtctgtagggtga

SEQ ID NO: 7767 - DNA, 16 bp, Artificial Sequence
  Synthetic polynucleotide
tatacccggcaagctc

SEQ ID NO: 7768 - DNA, 16 bp, Artificial Sequence
  Synthetic polynucleotide
gtcaagtggtatagcc

SEQ ID NO: 7769 - DNA, 16 bp, Artificial Sequence
  Synthetic polynucleotide
cgcagcactacgctcc

SEQ ID NO: 7770 - DNA, 16 bp, Artificial Sequence
  Synthetic polynucleotide
aaatactgcccacggt

SEQ ID NO: 7771 - DNA, 16 bp, Artificial Sequence
  Synthetic polynucleotide
attaggcactccataa

SEQ ID NO: 7772 - DNA, 16 bp, Artificial Sequence
  Synthetic polynucleotide
aggcgtctcaggaagt

SEQ ID NO: 7773 - DNA, 16 bp, Artificial Sequence
  Synthetic polynucleotide
gttttgtgctcgacaa

SEQ ID NO: 7774 - DNA, 16 bp, Artificial Sequence
  Synthetic polynucleotide
taccctccctctgcgg

SEQ ID NO: 7775 - DNA, 16 bp, Artificial Sequence
  Synthetic polynucleotide
cgcgaccacattggca

SEQ ID NO: 7776 - DNA, 16 bp, Artificial Sequence
  Synthetic polynucleotide
ctataagactactcca

SEQ ID NO: 7777 - DNA, 16 bp, Artificial Sequence
  Synthetic polynucleotide
accacctgttgaccga

SEQ ID NO: 7778 - DNA, 16 bp, Artificial Sequence
  Synthetic polynucleotide
tccagagctaagaaaa

SEQ ID NO: 7779 - DNA, 16 bp, Artificial Sequence
  Synthetic polynucleotide
cctcgtgatatcagag

SEQ ID NO: 7780 - DNA, 16 bp, Artificial Sequence
  Synthetic polynucleotide
gtcgtaactcggtcgc

SEQ ID NO: 7781 - DNA, 16 bp, Artificial Sequence
  Synthetic polynucleotide
ggtatgcattggctca

SEQ ID NO: 7782 - DNA, 16 bp, Artificial Sequence
  Synthetic polynucleotide
aaacgtctagtatttc

SEQ ID NO: 7783 - DNA, 16 bp, Artificial Sequence
  Synthetic polynucleotide
tagactcagcgtgagg

SEQ ID NO: 7784 - DNA, 16 bp, Artificial Sequence
  Synthetic polynucleotide
tatgggcctcatcccc

SEQ ID NO: 7785 - DNA, 16 bp, Artificial Sequence
  Synthetic polynucleotide
tgacgcagcatgtatg

SEQ ID NO: 7786 - DNA, 16 bp, Artificial Sequence
  Synthetic polynucleotide
tactcatcagcaccta

SEQ ID NO: 7787 - DNA, 16 bp, Artificial Sequence
  Synthetic polynucleotide
taacctggccatccct

SEQ ID NO: 7788 - DNA, 16 bp, Artificial Sequence
  Synthetic polynucleotide
cgagggtttgtttcac

SEQ ID NO: 7789 - DNA, 16 bp, Artificial Sequence
  Synthetic polynucleotide
gtatgatttccggttt

SEQ ID NO: 7790 - DNA, 16 bp, Artificial Sequence
  Synthetic polynucleotide
gggcactcgtataacc

SEQ ID NO: 7791 - DNA, 16 bp, Artificial Sequence
  Synthetic polynucleotide
acccgagcgcggccat

SEQ ID NO: 7792 - DNA, 16 bp, Artificial Sequence
  Synthetic polynucleotide
gttatttctatttcga

SEQ ID NO: 7793 - DNA, 16 bp, Artificial Sequence
  Synthetic polynucleotide
cactgagtcgctcagc

SEQ ID NO: 7794 - DNA, 16 bp, Artificial Sequence
  Synthetic polynucleotide
cggaacagccaaggca

SEQ ID NO: 7795 - DNA, 16 bp, Artificial Sequence
  Synthetic polynucleotide
acaggcggacagctaa

SEQ ID NO: 7796 - DNA, 16 bp, Artificial Sequence
  Synthetic polynucleotide
gaacttgaatcatggt

SEQ ID NO: 7797 - DNA, 16 bp, Artificial Sequence
  Synthetic polynucleotide
tcagaaacttccagct

SEQ ID NO: 7798 - DNA, 16 bp, Artificial Sequence
  Synthetic polynucleotide
tgacgatccgcagggt

SEQ ID NO: 7799 - DNA, 16 bp, Artificial Sequence
  Synthetic polynucleotide
gagggaactgcgatca

SEQ ID NO: 7800 - DNA, 16 bp, Artificial Sequence
  Synthetic polynucleotide
ttagtgaggtttcctt

SEQ ID NO: 7801 - DNA, 16 bp, Artificial Sequence
  Synthetic polynucleotide
ccaggtcaagttttgg

SEQ ID NO: 7802 - DNA, 16 bp, Artificial Sequence
  Synthetic polynucleotide
cttacatcgcccccta

SEQ ID NO: 7803 - DNA, 16 bp, Artificial Sequence
  Synthetic polynucleotide
agatgttctcagtcgt

SEQ ID NO: 7804 - DNA, 16 bp, Artificial Sequence
  Synthetic polynucleotide
cgagtcgtaacctcgt

SEQ ID NO: 7805 - DNA, 16 bp, Artificial Sequence
  Synthetic polynucleotide
ataatagtttaatttg

SEQ ID NO: 7806 - DNA, 16 bp, Artificial Sequence
  Synthetic polynucleotide
agtttcctcagaagtg

SEQ ID NO: 7807 - DNA, 16 bp, Artificial Sequence
  Synthetic polynucleotide
cccagtgaccaaggag

SEQ ID NO: 7808 - DNA, 16 bp, Artificial Sequence
  Synthetic polynucleotide
ggaatgcaacaccggc

SEQ ID NO: 7809 - DNA, 16 bp, Artificial Sequence
  Synthetic polynucleotide
ctaatatagtatagcg

SEQ ID NO: 7810 - DNA, 16 bp, Artificial Sequence
  Synthetic polynucleotide
ctcgacggaggatatg

SEQ ID NO: 7811 - DNA, 16 bp, Artificial Sequence
  Synthetic polynucleotide
tctttctctgggtaag

SEQ ID NO: 7812 - DNA, 16 bp, Artificial Sequence
  Synthetic polynucleotide
atgtggttccattacg

SEQ ID NO: 7813 - DNA, 16 bp, Artificial Sequence
  Synthetic polynucleotide
cacgcgagccaccgca

SEQ ID NO: 7814 - DNA, 16 bp, Artificial Sequence
  Synthetic polynucleotide
atcgactaggaaggac

SEQ ID NO: 7815 - DNA, 16 bp, Artificial Sequence
  Synthetic polynucleotide
gatagctgctatgtag

SEQ ID NO: 7816 - DNA, 16 bp, Artificial Sequence
  Synthetic polynucleotide
atctggtcattgaaag

SEQ ID NO: 7817 - DNA, 16 bp, Artificial Sequence
  Synthetic polynucleotide
gacagggagaatatgg

SEQ ID NO: 7818 - DNA, 16 bp, Artificial Sequence
  Synthetic polynucleotide
aaagactgtgcgagat

SEQ ID NO: 7819 - DNA, 16 bp, Artificial Sequence
  Synthetic polynucleotide
ggtcagaagctcgaca

SEQ ID NO: 7820 - DNA, 16 bp, Artificial Sequence
  Synthetic polynucleotide
agctctgttcctatga

SEQ ID NO: 7821 - DNA, 16 bp, Artificial Sequence
  Synthetic polynucleotide
cccccaagtgagcttt

SEQ ID NO: 7822 - DNA, 16 bp, Artificial Sequence
  Synthetic polynucleotide
gagtcggcctgacaga

SEQ ID NO: 7823 - DNA, 16 bp, Artificial Sequence
  Synthetic polynucleotide
tcatccggacgcttag

SEQ ID NO: 7824 - DNA, 16 bp, Artificial Sequence
  Synthetic polynucleotide
cgcccactctatgaac

SEQ ID NO: 7825 - DNA, 16 bp, Artificial Sequence
  Synthetic polynucleotide
ggcgcatattcataac

SEQ ID NO: 7826 - DNA, 16 bp, Artificial Sequence
  Synthetic polynucleotide
acactgacaccctttt

SEQ ID NO: 7827 - DNA, 16 bp, Artificial Sequence
  Synthetic polynucleotide
cctatcttggatatcg

SEQ ID NO: 7828 - DNA, 16 bp, Artificial Sequence
  Synthetic polynucleotide
cagcccattacccaca

SEQ ID NO: 7829 - DNA, 16 bp, Artificial Sequence
  Synthetic polynucleotide
agctgttcgctgtgac

SEQ ID NO: 7830 - DNA, 16 bp, Artificial Sequence
  Synthetic polynucleotide
cagagccgaggtcagg

SEQ ID NO: 7831 - DNA, 16 bp, Artificial Sequence
  Synthetic polynucleotide
ctaacgattccccgtc

SEQ ID NO: 7832 - DNA, 16 bp, Artificial Sequence
  Synthetic polynucleotide
tccaaaccaaattgtg

SEQ ID NO: 7833 - DNA, 16 bp, Artificial Sequence
  Synthetic polynucleotide
agattgtatcgagaaa

SEQ ID NO: 7834 - DNA, 16 bp, Artificial Sequence
  Synthetic polynucleotide
gcaccgaaaaaagccc

SEQ ID NO: 7835 - DNA, 16 bp, Artificial Sequence
  Synthetic polynucleotide
atcagttattacttcg

SEQ ID NO: 7836 - DNA, 16 bp, Artificial Sequence
  Synthetic polynucleotide
tgcccatggtgacacg

SEQ ID NO: 7837 - DNA, 16 bp, Artificial Sequence
  Synthetic polynucleotide
gtccaacaaggagaaa

SEQ ID NO: 7838 - DNA, 16 bp, Artificial Sequence
  Synthetic polynucleotide
aacagcatggcttcat

SEQ ID NO: 7839 - DNA, 16 bp, Artificial Sequence
  Synthetic polynucleotide
aggtggcctgataatc

SEQ ID NO: 7840 - DNA, 16 bp, Artificial Sequence
  Synthetic polynucleotide
tcccacgtacaacata

SEQ ID NO: 7841 - DNA, 16 bp, Artificial Sequence
  Synthetic polynucleotide
ctaccgctcccgagcc

SEQ ID NO: 7842 - DNA, 16 bp, Artificial Sequence
  Synthetic polynucleotide
agttcgtatatgctct

SEQ ID NO: 7843 - DNA, 16 bp, Artificial Sequence
  Synthetic polynucleotide
cttgacgagtgggagg

SEQ ID NO: 7844 - DNA, 16 bp, Artificial Sequence
  Synthetic polynucleotide
taattagtacggccac

SEQ ID NO: 7845 - DNA, 16 bp, Artificial Sequence
  Synthetic polynucleotide
gaccatagaaagcagg

SEQ ID NO: 7846 - DNA, 16 bp, Artificial Sequence
  Synthetic polynucleotide
gatactttgaaaaggc

SEQ ID NO: 7847 - DNA, 16 bp, Artificial Sequence
  Synthetic polynucleotide
aatgcacaaccatacc

SEQ ID NO: 7848 - DNA, 16 bp, Artificial Sequence
  Synthetic polynucleotide
aacggcgaataaaagc

SEQ ID NO: 7849 - DNA, 16 bp, Artificial Sequence
  Synthetic polynucleotide
cgtgcacatcacgtgg

SEQ ID NO: 7850 - DNA, 16 bp, Artificial Sequence
  Synthetic polynucleotide
cctctccctgccgagg

SEQ ID NO: 7851 - DNA, 16 bp, Artificial Sequence
  Synthetic polynucleotide
agtacgacatccctga

SEQ ID NO: 7852 - DNA, 16 bp, Artificial Sequence
  Synthetic polynucleotide
acggggttggggcata

SEQ ID NO: 7853 - DNA, 16 bp, Artificial Sequence
  Synthetic polynucleotide
agtatagtttgcttta

SEQ ID NO: 7854 - DNA, 16 bp, Artificial Sequence
  Synthetic polynucleotide
gaggcggcatcgggtt

SEQ ID NO: 7855 - DNA, 16 bp, Artificial Sequence
  Synthetic polynucleotide
cacttgaggcaaccta

SEQ ID NO: 7856 - DNA, 16 bp, Artificial Sequence
  Synthetic polynucleotide
ggtaggttccgccgca

SEQ ID NO: 7857 - DNA, 16 bp, Artificial Sequence
  Synthetic polynucleotide
caggctacactgttag

SEQ ID NO: 7858 - DNA, 16 bp, Artificial Sequence
  Synthetic polynucleotide
ggtacacggcctgttt

SEQ ID NO: 7859 - DNA, 16 bp, Artificial Sequence
  Synthetic polynucleotide
atgtagcagcgcgcct

SEQ ID NO: 7860 - DNA, 16 bp, Artificial Sequence
  Synthetic polynucleotide
tcaaggcccgacatcc

SEQ ID NO: 7861 - DNA, 16 bp, Artificial Sequence
  Synthetic polynucleotide
tatggtttagaaactg

SEQ ID NO: 7862 - DNA, 16 bp, Artificial Sequence
  Synthetic polynucleotide
taggttaaatcagcta

SEQ ID NO: 7863 - DNA, 16 bp, Artificial Sequence
  Synthetic polynucleotide
cgaatcaaggagcact

SEQ ID NO: 7864 - DNA, 16 bp, Artificial Sequence
  Synthetic polynucleotide
tcgcaacgaggacgat

SEQ ID NO: 7865 - DNA, 16 bp, Artificial Sequence
  Synthetic polynucleotide
actgtacgtatgtgat

SEQ ID NO: 7866 - DNA, 16 bp, Artificial Sequence
  Synthetic polynucleotide
gtcgcatatatcccaa

SEQ ID NO: 7867 - DNA, 16 bp, Artificial Sequence
  Synthetic polynucleotide
atatcaagggttggtt

SEQ ID NO: 7868 - DNA, 16 bp, Artificial Sequence
  Synthetic polynucleotide
cggcatgcggtctaaa

SEQ ID NO: 7869 - DNA, 16 bp, Artificial Sequence
  Synthetic polynucleotide
catatattgtccctca

SEQ ID NO: 7870 - DNA, 16 bp, Artificial Sequence
  Synthetic polynucleotide
gctatgctaggtagag

SEQ ID NO: 7871 - DNA, 16 bp, Artificial Sequence
  Synthetic polynucleotide
ctaatgaagaggatgt

SEQ ID NO: 7872 - DNA, 16 bp, Artificial Sequence
  Synthetic polynucleotide
acttgggattaggatc

SEQ ID NO: 7873 - DNA, 16 bp, Artificial Sequence
  Synthetic polynucleotide
cgaccatgttccgccc

SEQ ID NO: 7874 - DNA, 16 bp, Artificial Sequence
  Synthetic polynucleotide
tggagttagatgtccg

SEQ ID NO: 7875 - DNA, 16 bp, Artificial Sequence
  Synthetic polynucleotide
ctcggccccagtagaa

SEQ ID NO: 7876 - DNA, 16 bp, Artificial Sequence
  Synthetic polynucleotide
agcctacgtccgtgca

SEQ ID NO: 7877 - DNA, 16 bp, Artificial Sequence
  Synthetic polynucleotide
aataaggagcccagcg

SEQ ID NO: 7878 - DNA, 16 bp, Artificial Sequence
  Synthetic polynucleotide
gtttgaacctgtttac

SEQ ID NO: 7879 - DNA, 16 bp, Artificial Sequence
  Synthetic polynucleotide
tactaaaataagccac

SEQ ID NO: 7880 - DNA, 16 bp, Artificial Sequence
  Synthetic polynucleotide
agagtatagatggccg

SEQ ID NO: 7881 - DNA, 16 bp, Artificial Sequence
  Synthetic polynucleotide
ggaggcggtgggtgtt

SEQ ID NO: 7882 - DNA, 16 bp, Artificial Sequence
  Synthetic polynucleotide
ccaagtcagcccctcg

SEQ ID NO: 7883 - DNA, 16 bp, Artificial Sequence
  Synthetic polynucleotide
tagtttgatgactacc

SEQ ID NO: 7884 - DNA, 16 bp, Artificial Sequence
  Synthetic polynucleotide
gattgccgtaaatggt

SEQ ID NO: 7885 - DNA, 16 bp, Artificial Sequence
  Synthetic polynucleotide
tttttgtcgctgtatt

SEQ ID NO: 7886 - DNA, 16 bp, Artificial Sequence
  Synthetic polynucleotide
gtcgctggctaatcac

SEQ ID NO: 7887 - DNA, 16 bp, Artificial Sequence
  Synthetic polynucleotide
tagtccacgctgttca

SEQ ID NO: 7888 - DNA, 16 bp, Artificial Sequence
  Synthetic polynucleotide
acactaatccgggtat

SEQ ID NO: 7889 - DNA, 16 bp, Artificial Sequence
  Synthetic polynucleotide
ccgcacgtgcgctttc

SEQ ID NO: 7890 - DNA, 16 bp, Artificial Sequence
  Synthetic polynucleotide
cgtcttaaacgacttt

SEQ ID NO: 7891 - DNA, 16 bp, Artificial Sequence
  Synthetic polynucleotide
cctactctaggagaag

SEQ ID NO: 7892 - DNA, 16 bp, Artificial Sequence
  Synthetic polynucleotide
cacgacgacgggaatt

SEQ ID NO: 7893 - DNA, 16 bp, Artificial Sequence
  Synthetic polynucleotide
ggcgatacgcactgcc

SEQ ID NO: 7894 - DNA, 16 bp, Artificial Sequence
  Synthetic polynucleotide
ttccgcgtgggtatag

SEQ ID NO: 7895 - DNA, 16 bp, Artificial Sequence
  Synthetic polynucleotide
cagaaactagtggagc

SEQ ID NO: 7896 - DNA, 16 bp, Artificial Sequence
  Synthetic polynucleotide
tgtcgtataatgggta

SEQ ID NO: 7897 - DNA, 16 bp, Artificial Sequence
  Synthetic polynucleotide
gaggtagcaggtctac

SEQ ID NO: 7898 - DNA, 16 bp, Artificial Sequence
  Synthetic polynucleotide
gtgtcaagggaagttc

SEQ ID NO: 7899 - DNA, 16 bp, Artificial Sequence
  Synthetic polynucleotide
actctcgtgcgtatcg

SEQ ID NO: 7900 - DNA, 16 bp, Artificial Sequence
  Synthetic polynucleotide
tcctcggtagggtgta

SEQ ID NO: 7901 - DNA, 16 bp, Artificial Sequence
  Synthetic polynucleotide
cgagatgtatgccagc

SEQ ID NO: 7902 - DNA, 16 bp, Artificial Sequence
  Synthetic polynucleotide
tcatacgacaagaact

SEQ ID NO: 7903 - DNA, 16 bp, Artificial Sequence
  Synthetic polynucleotide
cgtcgtcttctcataa

SEQ ID NO: 7904 - DNA, 16 bp, Artificial Sequence
  Synthetic polynucleotide
aaaccgttatggtttc

SEQ ID NO: 7905 - DNA, 16 bp, Artificial Sequence
  Synthetic polynucleotide
tggatatcaggagatc

SEQ ID NO: 7906 - DNA, 16 bp, Artificial Sequence
  Synthetic polynucleotide
taactaagtggggcac

SEQ ID NO: 7907 - DNA, 16 bp, Artificial Sequence
  Synthetic polynucleotide
tcaagctgatgtaccg

SEQ ID NO: 7908 - DNA, 16 bp, Artificial Sequence
  Synthetic polynucleotide
aacagtgagctattcg

SEQ ID NO: 7909 - DNA, 16 bp, Artificial Sequence
  Synthetic polynucleotide
ccccaagtgtcttgcg

SEQ ID NO: 7910 - DNA, 16 bp, Artificial Sequence
  Synthetic polynucleotide
ggtacacctcacttgc

SEQ ID NO: 7911 - DNA, 16 bp, Artificial Sequence
  Synthetic polynucleotide
tcgtacaggctacatg

SEQ ID NO: 7912 - DNA, 16 bp, Artificial Sequence
  Synthetic polynucleotide
gcagtccgatgttggg

SEQ ID NO: 7913 - DNA, 16 bp, Artificial Sequence
  Synthetic polynucleotide
tatttgacggactcat

SEQ ID NO: 7914 - DNA, 16 bp, Artificial Sequence
  Synthetic polynucleotide
cctacaatagctttat

SEQ ID NO: 7915 - DNA, 16 bp, Artificial Sequence
  Synthetic polynucleotide
tgtgggctagcacgca

SEQ ID NO: 7916 - DNA, 16 bp, Artificial Sequence
  Synthetic polynucleotide
tttcaacttcttgcca

SEQ ID NO: 7917 - DNA, 16 bp, Artificial Sequence
  Synthetic polynucleotide
ctaggacctgtcaagt

SEQ ID NO: 7918 - DNA, 16 bp, Artificial Sequence
  Synthetic polynucleotide
gtgcagctatccgaat

SEQ ID NO: 7919 - DNA, 16 bp, Artificial Sequence
  Synthetic polynucleotide
tacgctattaaccctt

SEQ ID NO: 7920 - DNA, 16 bp, Artificial Sequence
  Synthetic polynucleotide
taagcgcgcacccgtt

SEQ ID NO: 7921 - DNA, 16 bp, Artificial Sequence
  Synthetic polynucleotide
gtgggagagtccggtc

SEQ ID NO: 7922 - DNA, 16 bp, Artificial Sequence
  Synthetic polynucleotide
gtgggtaagttatgga

SEQ ID NO: 7923 - DNA, 16 bp, Artificial Sequence
  Synthetic polynucleotide
agaaccggttggacgg

SEQ ID NO: 7924 - DNA, 16 bp, Artificial Sequence
  Synthetic polynucleotide
gcctggccctacttca

SEQ ID NO: 7925 - DNA, 16 bp, Artificial Sequence
  Synthetic polynucleotide
ccatgaaaactctagc

SEQ ID NO: 7926 - DNA, 16 bp, Artificial Sequence
  Synthetic polynucleotide
cggtgagattccccag

SEQ ID NO: 7927 - DNA, 16 bp, Artificial Sequence
  Synthetic polynucleotide
tacttgaatcgcgtcg

SEQ ID NO: 7928 - DNA, 16 bp, Artificial Sequence
  Synthetic polynucleotide
ccacaaagggtgtcag

SEQ ID NO: 7929 - DNA, 16 bp, Artificial Sequence
  Synthetic polynucleotide
gcgccagatcaccgaa

SEQ ID NO: 7930 - DNA, 16 bp, Artificial Sequence
  Synthetic polynucleotide
cgtacgcatacgattt

SEQ ID NO: 7931 - DNA, 16 bp, Artificial Sequence
  Synthetic polynucleotide
cggggagggtcctcac

SEQ ID NO: 7932 - DNA, 16 bp, Artificial Sequence
  Synthetic polynucleotide
ctctccgccatattgt

SEQ ID NO: 7933 - DNA, 16 bp, Artificial Sequence
  Synthetic polynucleotide
agcaggtcttgtaatg

SEQ ID NO: 7934 - DNA, 16 bp, Artificial Sequence
  Synthetic polynucleotide
acgactctcatctgat

SEQ ID NO: 7935 - DNA, 16 bp, Artificial Sequence
  Synthetic polynucleotide
aattcatcgttaatgc

SEQ ID NO: 7936 - DNA, 16 bp, Artificial Sequence
  Synthetic polynucleotide
gtgcatctacatggtc

SEQ ID NO: 7937 - DNA, 16 bp, Artificial Sequence
  Synthetic polynucleotide
tgcttatcccgaacga

SEQ ID NO: 7938 - DNA, 16 bp, Artificial Sequence
  Synthetic polynucleotide
ggaacttgatgtcatg

SEQ ID NO: 7939 - DNA, 16 bp, Artificial Sequence
  Synthetic polynucleotide
aaagcttcggtccttc

SEQ ID NO: 7940 - DNA, 16 bp, Artificial Sequence
  Synthetic polynucleotide
aattagaagtcgaatt

SEQ ID NO: 7941 - DNA, 16 bp, Artificial Sequence
  Synthetic polynucleotide
attaatacggctagaa

SEQ ID NO: 7942 - DNA, 16 bp, Artificial Sequence
  Synthetic polynucleotide
tgctggtgaaagatac

SEQ ID NO: 7943 - DNA, 16 bp, Artificial Sequence
  Synthetic polynucleotide
cgtcacttgacttgat

SEQ ID NO: 7944 - DNA, 16 bp, Artificial Sequence
  Synthetic polynucleotide
tgttttcgctaggtgg

SEQ ID NO: 7945 - DNA, 16 bp, Artificial Sequence
  Synthetic polynucleotide
gcttctcggctgagga

SEQ ID NO: 7946 - DNA, 16 bp, Artificial Sequence
  Synthetic polynucleotide
ctcgttcgggtgctac

SEQ ID NO: 7947 - DNA, 16 bp, Artificial Sequence
  Synthetic polynucleotide
gccttgtcatctatac

SEQ ID NO: 7948 - DNA, 16 bp, Artificial Sequence
  Synthetic polynucleotide
cgggtgtccctcaagc

SEQ ID NO: 7949 - DNA, 16 bp, Artificial Sequence
  Synthetic polynucleotide
gaggagcgctgaagcg

SEQ ID NO: 7950 - DNA, 16 bp, Artificial Sequence
  Synthetic polynucleotide
gcgttaaactgcccag

SEQ ID NO: 7951 - DNA, 16 bp, Artificial Sequence
  Synthetic polynucleotide
acccgagatgacatcg

SEQ ID NO: 7952 - DNA, 16 bp, Artificial Sequence
  Synthetic polynucleotide
tctgatggatctcagc

SEQ ID NO: 7953 - DNA, 16 bp, Artificial Sequence
  Synthetic polynucleotide
cccatggacccgctcg

SEQ ID NO: 7954 - DNA, 16 bp, Artificial Sequence
  Synthetic polynucleotide
ccacatgaaccgctct

SEQ ID NO: 7955 - DNA, 16 bp, Artificial Sequence
  Synthetic polynucleotide
gcctgtgatggtgaat

SEQ ID NO: 7956 - DNA, 16 bp, Artificial Sequence
  Synthetic polynucleotide
actcgctagtcaactt

SEQ ID NO: 7957 - DNA, 16 bp, Artificial Sequence
  Synthetic polynucleotide
accagttccgtagttc

SEQ ID NO: 7958 - DNA, 16 bp, Artificial Sequence
  Synthetic polynucleotide
gtaaacgataggtttc

SEQ ID NO: 7959 - DNA, 16 bp, Artificial Sequence
  Synthetic polynucleotide
tcacagtgcacaaggg

SEQ ID NO: 7960 - DNA, 16 bp, Artificial Sequence
  Synthetic polynucleotide
gattgggtatgaaaac

SEQ ID NO: 7961 - DNA, 16 bp, Artificial Sequence
  Synthetic polynucleotide
ccccggaagtggaaat

SEQ ID NO: 7962 - DNA, 16 bp, Artificial Sequence
  Synthetic polynucleotide
gccactacgatattca

SEQ ID NO: 7963 - DNA, 16 bp, Artificial Sequence
  Synthetic polynucleotide
ggagaatcttgattta

SEQ ID NO: 7964 - DNA, 16 bp, Artificial Sequence
  Synthetic polynucleotide
ccgaattatggtgtgt

SEQ ID NO: 7965 - DNA, 16 bp, Artificial Sequence
  Synthetic polynucleotide
gctctaaagctgccat

SEQ ID NO: 7966 - DNA, 16 bp, Artificial Sequence
  Synthetic polynucleotide
tctggttccccactgt

SEQ ID NO: 7967 - DNA, 16 bp, Artificial Sequence
  Synthetic polynucleotide
tctgatattaaggaat

SEQ ID NO: 7968 - DNA, 16 bp, Artificial Sequence
  Synthetic polynucleotide
cggacggaaaactaca

SEQ ID NO: 7969 - DNA, 16 bp, Artificial Sequence
  Synthetic polynucleotide
ctggttttctgtgctc

SEQ ID NO: 7970 - DNA, 16 bp, Artificial Sequence
  Synthetic polynucleotide
cccgagtccagcatta

SEQ ID NO: 7971 - DNA, 16 bp, Artificial Sequence
  Synthetic polynucleotide
ccgtaatcgattgcgc

SEQ ID NO: 7972 - DNA, 16 bp, Artificial Sequence
  Synthetic polynucleotide
gtaatggtcgtagtgg

SEQ ID NO: 7973 - DNA, 16 bp, Artificial Sequence
  Synthetic polynucleotide
tgccatgactaagccg

SEQ ID NO: 7974 - DNA, 16 bp, Artificial Sequence
  Synthetic polynucleotide
tataaagcgtttggaa

SEQ ID NO: 7975 - DNA, 16 bp, Artificial Sequence
  Synthetic polynucleotide
accaatcaaataactt

SEQ ID NO: 7976 - DNA, 16 bp, Artificial Sequence
  Synthetic polynucleotide
ctgtatgaatctatgt

SEQ ID NO: 7977 - DNA, 16 bp, Artificial Sequence
  Synthetic polynucleotide
gataatactacactaa

SEQ ID NO: 7978 - DNA, 16 bp, Artificial Sequence
  Synthetic polynucleotide
tgcggcgccctgcgaa

SEQ ID NO: 7979 - DNA, 16 bp, Artificial Sequence
  Synthetic polynucleotide
ttctgctaattgacgc

SEQ ID NO: 7980 - DNA, 16 bp, Artificial Sequence
  Synthetic polynucleotide
ccaccttattacgagt

SEQ ID NO: 7981 - DNA, 16 bp, Artificial Sequence
  Synthetic polynucleotide
cttcgtcagcaaatta

SEQ ID NO: 7982 - DNA, 16 bp, Artificial Sequence
  Synthetic polynucleotide
tacgagctagacctgt

SEQ ID NO: 7983 - DNA, 16 bp, Artificial Sequence
  Synthetic polynucleotide
aggaggtgtgacggag

SEQ ID NO: 7984 - DNA, 16 bp, Artificial Sequence
  Synthetic polynucleotide
ctagagctactcgccg

SEQ ID NO: 7985 - DNA, 16 bp, Artificial Sequence
  Synthetic polynucleotide
ctcccacaaccctaac

SEQ ID NO: 7986 - DNA, 16 bp, Artificial Sequence
  Synthetic polynucleotide
atagaatataggtcac

SEQ ID NO: 7987 - DNA, 16 bp, Artificial Sequence
  Synthetic polynucleotide
ggactatttaatgatc

SEQ ID NO: 7988 - DNA, 16 bp, Artificial Sequence
  Synthetic polynucleotide
tgtaccattatcaaag

SEQ ID NO: 7989 - DNA, 16 bp, Artificial Sequence
  Synthetic polynucleotide
agtaattgcatttctt

SEQ ID NO: 7990 - DNA, 16 bp, Artificial Sequence
  Synthetic polynucleotide
cgcggaactttaaacc

SEQ ID NO: 7991 - DNA, 16 bp, Artificial Sequence
  Synthetic polynucleotide
tactggagtcgctttt

SEQ ID NO: 7992 - DNA, 16 bp, Artificial Sequence
  Synthetic polynucleotide
taacacttggtctcga

SEQ ID NO: 7993 - DNA, 16 bp, Artificial Sequence
  Synthetic polynucleotide
gatgaacaaatggcaa

SEQ ID NO: 7994 - DNA, 16 bp, Artificial Sequence
  Synthetic polynucleotide
agcacgtagagataat

SEQ ID NO: 7995 - DNA, 16 bp, Artificial Sequence
  Synthetic polynucleotide
accattgtgggtgacc

SEQ ID NO: 7996 - DNA, 16 bp, Artificial Sequence
  Synthetic polynucleotide
atagaatgctattgag

SEQ ID NO: 7997 - DNA, 16 bp, Artificial Sequence
  Synthetic polynucleotide
cagtgcggcaaaagat

SEQ ID NO: 7998 - DNA, 16 bp, Artificial Sequence
  Synthetic polynucleotide
gttatacaggtccggc

SEQ ID NO: 7999 - DNA, 16 bp, Artificial Sequence
  Synthetic polynucleotide
gggagctgagtaaatg

SEQ ID NO: 8000 - DNA, 16 bp, Artificial Sequence
  Synthetic polynucleotide
ggtagaaggaactctg

SEQ ID NO: 8001 - DNA, 16 bp, Artificial Sequence
  Synthetic polynucleotide
ttatattaacttacct

SEQ ID NO: 8002 - DNA, 16 bp, Artificial Sequence
  Synthetic polynucleotide
cactcgcacttagatc

SEQ ID NO: 8003 - DNA, 16 bp, Artificial Sequence
  Synthetic polynucleotide
acttaatacgcggaca

SEQ ID NO: 8004 - DNA, 16 bp, Artificial Sequence
  Synthetic polynucleotide
gcggtaacatcacata

SEQ ID NO: 8005 - DNA, 16 bp, Artificial Sequence
  Synthetic polynucleotide
caggcaagcggcgaaa

SEQ ID NO: 8006 - DNA, 16 bp, Artificial Sequence
  Synthetic polynucleotide
acttacgtgtagtgtc

SEQ ID NO: 8007 - DNA, 16 bp, Artificial Sequence
  Synthetic polynucleotide
attactggcacaggat

SEQ ID NO: 8008 - DNA, 16 bp, Artificial Sequence
  Synthetic polynucleotide
ctggtctcaaacgtcc

SEQ ID NO: 8009 - DNA, 16 bp, Artificial Sequence
  Synthetic polynucleotide
aatgttctttcaggct

SEQ ID NO: 8010 - DNA, 16 bp, Artificial Sequence
  Synthetic polynucleotide
acctatatagccattt

SEQ ID NO: 8011 - DNA, 16 bp, Artificial Sequence
  Synthetic polynucleotide
gcagggtgcgaacccg

SEQ ID NO: 8012 - DNA, 16 bp, Artificial Sequence
  Synthetic polynucleotide
aactcatatacgtctt

SEQ ID NO: 8013 - DNA, 16 bp, Artificial Sequence
  Synthetic polynucleotide
gagctcacccgtcgat

SEQ ID NO: 8014 - DNA, 16 bp, Artificial Sequence
  Synthetic polynucleotide
cgaccattggtcattg

SEQ ID NO: 8015 - DNA, 16 bp, Artificial Sequence
  Synthetic polynucleotide
gccgatggaaaaatca

SEQ ID NO: 8016 - DNA, 16 bp, Artificial Sequence
  Synthetic polynucleotide
ctgctcctttagggtc

SEQ ID NO: 8017 - DNA, 16 bp, Artificial Sequence
  Synthetic polynucleotide
ctagtaactcaatttt

SEQ ID NO: 8018 - DNA, 16 bp, Artificial Sequence
  Synthetic polynucleotide
taccgagcaaagtatt

SEQ ID NO: 8019 - DNA, 16 bp, Artificial Sequence
  Synthetic polynucleotide
cctaggcgcaaggcgc

SEQ ID NO: 8020 - DNA, 16 bp, Artificial Sequence
  Synthetic polynucleotide
gaatatccccggttga

SEQ ID NO: 8021 - DNA, 16 bp, Artificial Sequence
  Synthetic polynucleotide
cgtttattgaggttag

SEQ ID NO: 8022 - DNA, 16 bp, Artificial Sequence
  Synthetic polynucleotide
cgctgatccggtttac

SEQ ID NO: 8023 - DNA, 16 bp, Artificial Sequence
  Synthetic polynucleotide
aagagcaattatgtga

SEQ ID NO: 8024 - DNA, 16 bp, Artificial Sequence
  Synthetic polynucleotide
ccccttcgtttaaaga

SEQ ID NO: 8025 - DNA, 16 bp, Artificial Sequence
  Synthetic polynucleotide
ctgaaggaagacgtcc

SEQ ID NO: 8026 - DNA, 16 bp, Artificial Sequence
  Synthetic polynucleotide
tggctcgtacccatcc

SEQ ID NO: 8027 - DNA, 16 bp, Artificial Sequence
  Synthetic polynucleotide
agggttcataggcgga

SEQ ID NO: 8028 - DNA, 16 bp, Artificial Sequence
  Synthetic polynucleotide
agatgcgatttgtacg

SEQ ID NO: 8029 - DNA, 16 bp, Artificial Sequence
  Synthetic polynucleotide
taggcaagcgatagta

SEQ ID NO: 8030 - DNA, 16 bp, Artificial Sequence
  Synthetic polynucleotide
gaaaactgcacaactt

SEQ ID NO: 8031 - DNA, 16 bp, Artificial Sequence
  Synthetic polynucleotide
cctagaactaagaaca

SEQ ID NO: 8032 - DNA, 16 bp, Artificial Sequence
  Synthetic polynucleotide
cccgacaaggcagcag

SEQ ID NO: 8033 - DNA, 16 bp, Artificial Sequence
  Synthetic polynucleotide
tggtcggtccccgctc

SEQ ID NO: 8034 - DNA, 16 bp, Artificial Sequence
  Synthetic polynucleotide
caacattttatctctt

SEQ ID NO: 8035 - DNA, 16 bp, Artificial Sequence
  Synthetic polynucleotide
tgggagaatagcgcct

SEQ ID NO: 8036 - DNA, 16 bp, Artificial Sequence
  Synthetic polynucleotide
gcgcgggctgactctt

SEQ ID NO: 8037 - DNA, 16 bp, Artificial Sequence
  Synthetic polynucleotide
ggtatttttatccatt

SEQ ID NO: 8038 - DNA, 16 bp, Artificial Sequence
  Synthetic polynucleotide
tgatcctgcgtacctt

SEQ ID NO: 8039 - DNA, 16 bp, Artificial Sequence
  Synthetic polynucleotide
gcccgacggatgcgtt

SEQ ID NO: 8040 - DNA, 16 bp, Artificial Sequence
  Synthetic polynucleotide
gatgatatggtaatcc

SEQ ID NO: 8041 - DNA, 16 bp, Artificial Sequence
  Synthetic polynucleotide
acctaatgcgaaggtc

SEQ ID NO: 8042 - DNA, 16 bp, Artificial Sequence
  Synthetic polynucleotide
gccagtaggccgggct

SEQ ID NO: 8043 - DNA, 16 bp, Artificial Sequence
  Synthetic polynucleotide
gatatcgctataatag

SEQ ID NO: 8044 - DNA, 16 bp, Artificial Sequence
  Synthetic polynucleotide
gctgatgccctgcttc

SEQ ID NO: 8045 - DNA, 16 bp, Artificial Sequence
  Synthetic polynucleotide
acagtgcccgcattca

SEQ ID NO: 8046 - DNA, 16 bp, Artificial Sequence
  Synthetic polynucleotide
ccatatgacttgtact

SEQ ID NO: 8047 - DNA, 16 bp, Artificial Sequence
  Synthetic polynucleotide
tattgaagacactcac

SEQ ID NO: 8048 - DNA, 16 bp, Artificial Sequence
  Synthetic polynucleotide
cccgcgtatcgggaca

SEQ ID NO: 8049 - DNA, 16 bp, Artificial Sequence
  Synthetic polynucleotide
aggtcatcctacaact

SEQ ID NO: 8050 - DNA, 16 bp, Artificial Sequence
  Synthetic polynucleotide
gcactaagcgcctccg

SEQ ID NO: 8051 - DNA, 16 bp, Artificial Sequence
  Synthetic polynucleotide
ttacacataggctgcg

SEQ ID NO: 8052 - DNA, 16 bp, Artificial Sequence
  Synthetic polynucleotide
aagttgaatcgtctac

SEQ ID NO: 8053 - DNA, 16 bp, Artificial Sequence
  Synthetic polynucleotide
gctgtgccgcccacca

SEQ ID NO: 8054 - DNA, 16 bp, Artificial Sequence
  Synthetic polynucleotide
cgtcccatattttata

SEQ ID NO: 8055 - DNA, 16 bp, Artificial Sequence
  Synthetic polynucleotide
caaagggcatgtgaag

SEQ ID NO: 8056 - DNA, 16 bp, Artificial Sequence
  Synthetic polynucleotide
cgatgcttttgccaca

SEQ ID NO: 8057 - DNA, 16 bp, Artificial Sequence
  Synthetic polynucleotide
aggatggcgtgaaccc

SEQ ID NO: 8058 - DNA, 16 bp, Artificial Sequence
  Synthetic polynucleotide
taacagcaggtcggcc

SEQ ID NO: 8059 - DNA, 16 bp, Artificial Sequence
  Synthetic polynucleotide
tttacgctaagcgggt

SEQ ID NO: 8060 - DNA, 16 bp, Artificial Sequence
  Synthetic polynucleotide
acatgaggtggctggt

SEQ ID NO: 8061 - DNA, 16 bp, Artificial Sequence
  Synthetic polynucleotide
gtggcgctgtcaagac

SEQ ID NO: 8062 - DNA, 16 bp, Artificial Sequence
  Synthetic polynucleotide
ataccctattgtcgtt

SEQ ID NO: 8063 - DNA, 16 bp, Artificial Sequence
  Synthetic polynucleotide
acgggacattgttcat

SEQ ID NO: 8064 - DNA, 16 bp, Artificial Sequence
  Synthetic polynucleotide
acttggacaaagtgag

SEQ ID NO: 8065 - DNA, 16 bp, Artificial Sequence
  Synthetic polynucleotide
acattactgccctaac

SEQ ID NO: 8066 - DNA, 16 bp, Artificial Sequence
  Synthetic polynucleotide
agtgttttatgctggg

SEQ ID NO: 8067 - DNA, 16 bp, Artificial Sequence
  Synthetic polynucleotide
agtaacgcggcactag

SEQ ID NO: 8068 - DNA, 16 bp, Artificial Sequence
  Synthetic polynucleotide
cgtgacggtgaatctt

SEQ ID NO: 8069 - DNA, 16 bp, Artificial Sequence
  Synthetic polynucleotide
cataccgtagcgggtc

SEQ ID NO: 8070 - DNA, 16 bp, Artificial Sequence
  Synthetic polynucleotide
atcatgagttttttgt

SEQ ID NO: 8071 - DNA, 16 bp, Artificial Sequence
  Synthetic polynucleotide
ggggactcgcgtagct

SEQ ID NO: 8072 - DNA, 16 bp, Artificial Sequence
  Synthetic polynucleotide
gatagagaactgtccc

SEQ ID NO: 8073 - DNA, 16 bp, Artificial Sequence
  Synthetic polynucleotide
ctgaatggtattcttc

SEQ ID NO: 8074 - DNA, 16 bp, Artificial Sequence
  Synthetic polynucleotide
ttctgaatcgcgggct

SEQ ID NO: 8075 - DNA, 16 bp, Artificial Sequence
  Synthetic polynucleotide
actcgtcgcctgtgaa

SEQ ID NO: 8076 - DNA, 16 bp, Artificial Sequence
  Synthetic polynucleotide
atcccggatcttgtat

SEQ ID NO: 8077 - DNA, 16 bp, Artificial Sequence
  Synthetic polynucleotide
agacatagatgccgtt

SEQ ID NO: 8078 - DNA, 16 bp, Artificial Sequence
  Synthetic polynucleotide
cgtaggagttgaccta

SEQ ID NO: 8079 - DNA, 16 bp, Artificial Sequence
  Synthetic polynucleotide
tattgctcaggcctcg

SEQ ID NO: 8080 - DNA, 16 bp, Artificial Sequence
  Synthetic polynucleotide
cttggacattgcgctt

SEQ ID NO: 8081 - DNA, 16 bp, Artificial Sequence
  Synthetic polynucleotide
cttacttgtcaatttc

SEQ ID NO: 8082 - DNA, 16 bp, Artificial Sequence
  Synthetic polynucleotide
cttccatgtaattata

SEQ ID NO: 8083 - DNA, 16 bp, Artificial Sequence
  Synthetic polynucleotide
gctcattcacgccctg

SEQ ID NO: 8084 - DNA, 16 bp, Artificial Sequence
  Synthetic polynucleotide
ttaaccataaggtccg

SEQ ID NO: 8085 - DNA, 16 bp, Artificial Sequence
  Synthetic polynucleotide
ccagcagtggtgcgtc

SEQ ID NO: 8086 - DNA, 16 bp, Artificial Sequence
  Synthetic polynucleotide
gaccacgtcctctcct

SEQ ID NO: 8087 - DNA, 16 bp, Artificial Sequence
  Synthetic polynucleotide
ctccgcatcccggtca

SEQ ID NO: 8088 - DNA, 16 bp, Artificial Sequence
  Synthetic polynucleotide
cgcgagaccctcacgc

SEQ ID NO: 8089 - DNA, 16 bp, Artificial Sequence
  Synthetic polynucleotide
taacaagggcctacct

SEQ ID NO: 8090 - DNA, 16 bp, Artificial Sequence
  Synthetic polynucleotide
acacagtgtgcagggt

SEQ ID NO: 8091 - DNA, 16 bp, Artificial Sequence
  Synthetic polynucleotide
gcgacgcttgccatcg

SEQ ID NO: 8092 - DNA, 16 bp, Artificial Sequence
  Synthetic polynucleotide
ttttaacacatacatg

SEQ ID NO: 8093 - DNA, 16 bp, Artificial Sequence
  Synthetic polynucleotide
gaaggctgcactttaa

SEQ ID NO: 8094 - DNA, 16 bp, Artificial Sequence
  Synthetic polynucleotide
gagccgatggagtgtt

SEQ ID NO: 8095 - DNA, 16 bp, Artificial Sequence
  Synthetic polynucleotide
cggcgccgcttggtaa

SEQ ID NO: 8096 - DNA, 16 bp, Artificial Sequence
  Synthetic polynucleotide
cacaaaactgccaatg

SEQ ID NO: 8097 - DNA, 16 bp, Artificial Sequence
  Synthetic polynucleotide
ggttgcggtgatcaat

SEQ ID NO: 8098 - DNA, 16 bp, Artificial Sequence
  Synthetic polynucleotide
atcggattccggcgga

SEQ ID NO: 8099 - DNA, 16 bp, Artificial Sequence
  Synthetic polynucleotide
cccggtggcacgtaaa

SEQ ID NO: 8100 - DNA, 16 bp, Artificial Sequence
  Synthetic polynucleotide
caggtggtctctgata

SEQ ID NO: 8101 - DNA, 16 bp, Artificial Sequence
  Synthetic polynucleotide
gttgttccggaacaga

SEQ ID NO: 8102 - DNA, 16 bp, Artificial Sequence
  Synthetic polynucleotide
ctgctttttataaaaa

SEQ ID NO: 8103 - DNA, 16 bp, Artificial Sequence
  Synthetic polynucleotide
atgttccgcgggcatc

SEQ ID NO: 8104 - DNA, 16 bp, Artificial Sequence
  Synthetic polynucleotide
agtcaatctccccgga

SEQ ID NO: 8105 - DNA, 16 bp, Artificial Sequence
  Synthetic polynucleotide
gcggcgaacatcgtgc

SEQ ID NO: 8106 - DNA, 16 bp, Artificial Sequence
  Synthetic polynucleotide
cgtgggacattccacg

SEQ ID NO: 8107 - DNA, 16 bp, Artificial Sequence
  Synthetic polynucleotide
ctgctgaaaaaacgac

SEQ ID NO: 8108 - DNA, 16 bp, Artificial Sequence
  Synthetic polynucleotide
cgggtataggagcgta

SEQ ID NO: 8109 - DNA, 16 bp, Artificial Sequence
  Synthetic polynucleotide
gccaaaatgagtaagg

SEQ ID NO: 8110 - DNA, 16 bp, Artificial Sequence
  Synthetic polynucleotide
gctaagggttttgcat

SEQ ID NO: 8111 - DNA, 16 bp, Artificial Sequence
  Synthetic polynucleotide
gcgccagaccatgcga

SEQ ID NO: 8112 - DNA, 16 bp, Artificial Sequence
  Synthetic polynucleotide
ttgttgcggcctcgtg

SEQ ID NO: 8113 - DNA, 16 bp, Artificial Sequence
  Synthetic polynucleotide
ggcggatactaagccg

SEQ ID NO: 8114 - DNA, 16 bp, Artificial Sequence
  Synthetic polynucleotide
gacccaggtaggttat

SEQ ID NO: 8115 - DNA, 16 bp, Artificial Sequence
  Synthetic polynucleotide
cgtcctgtgcgagata

SEQ ID NO: 8116 - DNA, 16 bp, Artificial Sequence
  Synthetic polynucleotide
tagatgcgactacacc

SEQ ID NO: 8117 - DNA, 16 bp, Artificial Sequence
  Synthetic polynucleotide
cagagatggagaacat

SEQ ID NO: 8118 - DNA, 16 bp, Artificial Sequence
  Synthetic polynucleotide
tcacataccagctgga

SEQ ID NO: 8119 - DNA, 16 bp, Artificial Sequence
  Synthetic polynucleotide
atattgtaaacggttt

SEQ ID NO: 8120 - DNA, 16 bp, Artificial Sequence
  Synthetic polynucleotide
agcgtgatgcaggcgt

SEQ ID NO: 8121 - DNA, 16 bp, Artificial Sequence
  Synthetic polynucleotide
accttcaaatataact

SEQ ID NO: 8122 - DNA, 16 bp, Artificial Sequence
  Synthetic polynucleotide
ccatattaacctgcca

SEQ ID NO: 8123 - DNA, 16 bp, Artificial Sequence
  Synthetic polynucleotide
gactctcttggttcaa

SEQ ID NO: 8124 - DNA, 16 bp, Artificial Sequence
  Synthetic polynucleotide
cgatgcgggcgagggt

SEQ ID NO: 8125 - DNA, 16 bp, Artificial Sequence
  Synthetic polynucleotide
ctcaataaagggctgc

SEQ ID NO: 8126 - DNA, 16 bp, Artificial Sequence
  Synthetic polynucleotide
gcatgagaggcgcaga

SEQ ID NO: 8127 - DNA, 16 bp, Artificial Sequence
  Synthetic polynucleotide
ttgtgaacttgcgggg

SEQ ID NO: 8128 - DNA, 16 bp, Artificial Sequence
  Synthetic polynucleotide
agtgtggtctgtttaa

SEQ ID NO: 8129 - DNA, 16 bp, Artificial Sequence
  Synthetic polynucleotide
ctgtactataacggcc

SEQ ID NO: 8130 - DNA, 16 bp, Artificial Sequence
  Synthetic polynucleotide
gactctaccctgggaa

SEQ ID NO: 8131 - DNA, 16 bp, Artificial Sequence
  Synthetic polynucleotide
atcccctcatcgctga

SEQ ID NO: 8132 - DNA, 16 bp, Artificial Sequence
  Synthetic polynucleotide
catcttaacgaccgtt

SEQ ID NO: 8133 - DNA, 16 bp, Artificial Sequence
  Synthetic polynucleotide
cgatagaagtagttaa

SEQ ID NO: 8134 - DNA, 16 bp, Artificial Sequence
  Synthetic polynucleotide
agaactcttgatgtcc

SEQ ID NO: 8135 - DNA, 16 bp, Artificial Sequence
  Synthetic polynucleotide
ttgtcttatcacccta

SEQ ID NO: 8136 - DNA, 16 bp, Artificial Sequence
  Synthetic polynucleotide
catacacaccacaatg

SEQ ID NO: 8137 - DNA, 16 bp, Artificial Sequence
  Synthetic polynucleotide
tcatggtaaccgtggg

SEQ ID NO: 8138 - DNA, 16 bp, Artificial Sequence
  Synthetic polynucleotide
aaactgagtaagacct

SEQ ID NO: 8139 - DNA, 16 bp, Artificial Sequence
  Synthetic polynucleotide
cacttgactggagtag

SEQ ID NO: 8140 - DNA, 16 bp, Artificial Sequence
  Synthetic polynucleotide
gttagtggtggcaccc

SEQ ID NO: 8141 - DNA, 16 bp, Artificial Sequence
  Synthetic polynucleotide
agacgcctgcgaccga

SEQ ID NO: 8142 - DNA, 16 bp, Artificial Sequence
  Synthetic polynucleotide
tccctaaatgtccgtg

SEQ ID NO: 8143 - DNA, 16 bp, Artificial Sequence
  Synthetic polynucleotide
gctctggaggggatga

SEQ ID NO: 8144 - DNA, 16 bp, Artificial Sequence
  Synthetic polynucleotide
tttgcaccacctatac

SEQ ID NO: 8145 - DNA, 16 bp, Artificial Sequence
  Synthetic polynucleotide
agacgttttaggtgct

SEQ ID NO: 8146 - DNA, 16 bp, Artificial Sequence
  Synthetic polynucleotide
aatattgcagtattcc

SEQ ID NO: 8147 - DNA, 16 bp, Artificial Sequence
  Synthetic polynucleotide
ccaggttaagtggctc

SEQ ID NO: 8148 - DNA, 16 bp, Artificial Sequence
  Synthetic polynucleotide
aatcatactcacggtt

SEQ ID NO: 8149 - DNA, 16 bp, Artificial Sequence
  Synthetic polynucleotide
ccgtcgagccctgcgc

SEQ ID NO: 8150 - DNA, 16 bp, Artificial Sequence
  Synthetic polynucleotide
tagtcgattacgcttc

SEQ ID NO: 8151 - DNA, 16 bp, Artificial Sequence
  Synthetic polynucleotide
actccggcctccttgg

SEQ ID NO: 8152 - DNA, 16 bp, Artificial Sequence
  Synthetic polynucleotide
tatattagcttaccca

SEQ ID NO: 8153 - DNA, 16 bp, Artificial Sequence
  Synthetic polynucleotide
ctcgcgtggcacgtct

SEQ ID NO: 8154 - DNA, 16 bp, Artificial Sequence
  Synthetic polynucleotide
aaccctcggaggcaag

SEQ ID NO: 8155 - DNA, 16 bp, Artificial Sequence
  Synthetic polynucleotide
gagtgccccctcggca

SEQ ID NO: 8156 - DNA, 16 bp, Artificial Sequence
  Synthetic polynucleotide
ccatagctaacccgat

SEQ ID NO: 8157 - DNA, 16 bp, Artificial Sequence
  Synthetic polynucleotide
tgtgcattccacgtga

SEQ ID NO: 8158 - DNA, 16 bp, Artificial Sequence
  Synthetic polynucleotide
gtcgtacttaaagcaa

SEQ ID NO: 8159 - DNA, 16 bp, Artificial Sequence
  Synthetic polynucleotide
ttaagacggccggtgt

SEQ ID NO: 8160 - DNA, 16 bp, Artificial Sequence
  Synthetic polynucleotide
acgcggaacgtaatgg

SEQ ID NO: 8161 - DNA, 16 bp, Artificial Sequence
  Synthetic polynucleotide
taccggggtgaacagc

SEQ ID NO: 8162 - DNA, 16 bp, Artificial Sequence
  Synthetic polynucleotide
acgtgcggcttctcct

SEQ ID NO: 8163 - DNA, 16 bp, Artificial Sequence
  Synthetic polynucleotide
gtatcgccttgtgtat

SEQ ID NO: 8164 - DNA, 16 bp, Artificial Sequence
  Synthetic polynucleotide
tcgccgtttgctcgcg

SEQ ID NO: 8165 - DNA, 16 bp, Artificial Sequence
  Synthetic polynucleotide
aaccccgtaaatcgta

SEQ ID NO: 8166 - DNA, 16 bp, Artificial Sequence
  Synthetic polynucleotide
gggactggatcagatg

SEQ ID NO: 8167 - DNA, 16 bp, Artificial Sequence
  Synthetic polynucleotide
ttcaagtattcggtga

SEQ ID NO: 8168 - DNA, 16 bp, Artificial Sequence
  Synthetic polynucleotide
cctccccgcattacaa

SEQ ID NO: 8169 - DNA, 16 bp, Artificial Sequence
  Synthetic polynucleotide
gactcgggatacccgg

SEQ ID NO: 8170 - DNA, 16 bp, Artificial Sequence
  Synthetic polynucleotide
gctttataaattcccg

SEQ ID NO: 8171 - DNA, 16 bp, Artificial Sequence
  Synthetic polynucleotide
aatctcggattcctta

SEQ ID NO: 8172 - DNA, 16 bp, Artificial Sequence
  Synthetic polynucleotide
aaaaccaggcgcaatc

SEQ ID NO: 8173 - DNA, 16 bp, Artificial Sequence
  Synthetic polynucleotide
tcatggcataaacgaa

SEQ ID NO: 8174 - DNA, 16 bp, Artificial Sequence
  Synthetic polynucleotide
ctttgtggtccactat

SEQ ID NO: 8175 - DNA, 16 bp, Artificial Sequence
  Synthetic polynucleotide
gcggagagaaatggct

SEQ ID NO: 8176 - DNA, 16 bp, Artificial Sequence
  Synthetic polynucleotide
tgagcgatcaatgacc

SEQ ID NO: 8177 - DNA, 16 bp, Artificial Sequence
  Synthetic polynucleotide
ccagtaatagcctgaa

SEQ ID NO: 8178 - DNA, 16 bp, Artificial Sequence
  Synthetic polynucleotide
caccctgcatcgacgg

SEQ ID NO: 8179 - DNA, 16 bp, Artificial Sequence
  Synthetic polynucleotide
cttagtgctgtagttt

SEQ ID NO: 8180 - DNA, 16 bp, Artificial Sequence
  Synthetic polynucleotide
atgggacgccactacg

SEQ ID NO: 8181 - DNA, 16 bp, Artificial Sequence
  Synthetic polynucleotide
ctttcagtgtgagtgt

SEQ ID NO: 8182 - DNA, 16 bp, Artificial Sequence
  Synthetic polynucleotide
gatgacctcgcagcct

SEQ ID NO: 8183 - DNA, 16 bp, Artificial Sequence
  Synthetic polynucleotide
ggcacagcttggcgat

SEQ ID NO: 8184 - DNA, 16 bp, Artificial Sequence
  Synthetic polynucleotide
gagaccaggcgtccgg

SEQ ID NO: 8185 - DNA, 16 bp, Artificial Sequence
  Synthetic polynucleotide
tatgagttaccctgca

SEQ ID NO: 8186 - DNA, 16 bp, Artificial Sequence
  Synthetic polynucleotide
tgataattaacactcc

SEQ ID NO: 8187 - DNA, 16 bp, Artificial Sequence
  Synthetic polynucleotide
atgcggagaggtaggc

SEQ ID NO: 8188 - DNA, 16 bp, Artificial Sequence
  Synthetic polynucleotide
agcgtcgcttaaagtg

SEQ ID NO: 8189 - DNA, 16 bp, Artificial Sequence
  Synthetic polynucleotide
accacacttgtcccga

SEQ ID NO: 8190 - DNA, 16 bp, Artificial Sequence
  Synthetic polynucleotide
gtagagtcgtagacga

SEQ ID NO: 8191 - DNA, 16 bp, Artificial Sequence
  Synthetic polynucleotide
tcgtgcgaatgtactc

SEQ ID NO: 8192 - DNA, 16 bp, Artificial Sequence
  Synthetic polynucleotide
gttcacaagctggcta

SEQ ID NO: 8193 - DNA, 16 bp, Artificial Sequence
  Synthetic polynucleotide
tagtacagtgggagtg

SEQ ID NO: 8194 - DNA, 16 bp, Artificial Sequence
  Synthetic polynucleotide
gtctcgcgagacgcta

SEQ ID NO: 8195 - DNA, 16 bp, Artificial Sequence
  Synthetic polynucleotide
tgttaaaacccacagg

SEQ ID NO: 8196 - DNA, 16 bp, Artificial Sequence
  Synthetic polynucleotide
aacttcggggcgcatt

SEQ ID NO: 8197 - DNA, 16 bp, Artificial Sequence
  Synthetic polynucleotide
agcgaattgagccact

SEQ ID NO: 8198 - DNA, 16 bp, Artificial Sequence
  Synthetic polynucleotide
caccgttcaaccgtga

SEQ ID NO: 8199 - DNA, 16 bp, Artificial Sequence
  Synthetic polynucleotide
caacagttgtgcgttg

SEQ ID NO: 8200 - DNA, 16 bp, Artificial Sequence
  Synthetic polynucleotide
ctatcttcgagatgcg

SEQ ID NO: 8201 - DNA, 16 bp, Artificial Sequence
  Synthetic polynucleotide
gtattagcttgagact

SEQ ID NO: 8202 - DNA, 16 bp, Artificial Sequence
  Synthetic polynucleotide
ggggtcactactcgat

SEQ ID NO: 8203 - DNA, 16 bp, Artificial Sequence
  Synthetic polynucleotide
atgaacaccccgctgc

SEQ ID NO: 8204 - DNA, 16 bp, Artificial Sequence
  Synthetic polynucleotide
gggctgatcccgcaac

SEQ ID NO: 8205 - DNA, 16 bp, Artificial Sequence
  Synthetic polynucleotide
ccatatcctaagcgtt

SEQ ID NO: 8206 - DNA, 16 bp, Artificial Sequence
  Synthetic polynucleotide
tatgattggttccggt

SEQ ID NO: 8207 - DNA, 16 bp, Artificial Sequence
  Synthetic polynucleotide
gcatcagatcgcgatc

SEQ ID NO: 8208 - DNA, 16 bp, Artificial Sequence
  Synthetic polynucleotide
ggcatcacctagaaat

SEQ ID NO: 8209 - DNA, 16 bp, Artificial Sequence
  Synthetic polynucleotide
caccagaacctagcta

SEQ ID NO: 8210 - DNA, 16 bp, Artificial Sequence
  Synthetic polynucleotide
agcttgggccattata

SEQ ID NO: 8211 - DNA, 16 bp, Artificial Sequence
  Synthetic polynucleotide
atccttccaacatctc

SEQ ID NO: 8212 - DNA, 16 bp, Artificial Sequence
  Synthetic polynucleotide
ctttacgcgcttgaac

SEQ ID NO: 8213 - DNA, 16 bp, Artificial Sequence
  Synthetic polynucleotide
gcgggccgcaaccaaa

SEQ ID NO: 8214 - DNA, 16 bp, Artificial Sequence
  Synthetic polynucleotide
attaccgtatagccag

SEQ ID NO: 8215 - DNA, 16 bp, Artificial Sequence
  Synthetic polynucleotide
ccagccgcgcgcaggg

SEQ ID NO: 8216 - DNA, 16 bp, Artificial Sequence
  Synthetic polynucleotide
cgtttgtcgaagcgta

SEQ ID NO: 8217 - DNA, 16 bp, Artificial Sequence
  Synthetic polynucleotide
ccacggaagagtacat

SEQ ID NO: 8218 - DNA, 16 bp, Artificial Sequence
  Synthetic polynucleotide
gatcaccctagccagc

SEQ ID NO: 8219 - DNA, 16 bp, Artificial Sequence
  Synthetic polynucleotide
cgaacgcacccctcag

SEQ ID NO: 8220 - DNA, 16 bp, Artificial Sequence
  Synthetic polynucleotide
ttgtgctgcacagcac

SEQ ID NO: 8221 - DNA, 16 bp, Artificial Sequence
  Synthetic polynucleotide
cgccgtgtcgaagtct

SEQ ID NO: 8222 - DNA, 16 bp, Artificial Sequence
  Synthetic polynucleotide
atgaatccggtatgct

SEQ ID NO: 8223 - DNA, 16 bp, Artificial Sequence
  Synthetic polynucleotide
tcggcagcttgctagg

SEQ ID NO: 8224 - DNA, 16 bp, Artificial Sequence
  Synthetic polynucleotide
caacacaattaggtaa

SEQ ID NO: 8225 - DNA, 16 bp, Artificial Sequence
  Synthetic polynucleotide
cagactacacaatttc

SEQ ID NO: 8226 - DNA, 16 bp, Artificial Sequence
  Synthetic polynucleotide
cagtattttgttctac

SEQ ID NO: 8227 - DNA, 16 bp, Artificial Sequence
  Synthetic polynucleotide
gtgtacctgagcttgc

SEQ ID NO: 8228 - DNA, 16 bp, Artificial Sequence
  Synthetic polynucleotide
gtgctgcgttatggag

SEQ ID NO: 8229 - DNA, 16 bp, Artificial Sequence
  Synthetic polynucleotide
tcttatagcgtgtctg

SEQ ID NO: 8230 - DNA, 16 bp, Artificial Sequence
  Synthetic polynucleotide
gttacgacggctatac

SEQ ID NO: 8231 - DNA, 16 bp, Artificial Sequence
  Synthetic polynucleotide
tggtcgcgtcggtcaa

SEQ ID NO: 8232 - DNA, 16 bp, Artificial Sequence
  Synthetic polynucleotide
tcacgaggtgagccaa

SEQ ID NO: 8233 - DNA, 16 bp, Artificial Sequence
  Synthetic polynucleotide
ggcccataccgcagag

SEQ ID NO: 8234 - DNA, 16 bp, Artificial Sequence
  Synthetic polynucleotide
gatgagtattttctta

SEQ ID NO: 8235 - DNA, 16 bp, Artificial Sequence
  Synthetic polynucleotide
tgagtctacctgtggg

SEQ ID NO: 8236 - DNA, 16 bp, Artificial Sequence
  Synthetic polynucleotide
ctgcgtcaaatgcgcc

SEQ ID NO: 8237 - DNA, 32 bp, Artificial Sequence
  Synthetic polynucleotide
tttttttttgtcctatgtttactttttttttt

SEQ ID NO: 8238 - DNA, 32 bp, Artificial Sequence
  Synthetic polynucleotide
aactgttgttttttttttttttttagggatgg

SEQ ID NO: 8239 - DNA, 32 bp, Artificial Sequence
  Synthetic polynucleotide
ttttttttcaacgcacgctcgggttttttttt

SEQ ID NO: 8240 - DNA, 32 bp, Artificial Sequence
  Synthetic polynucleotide
tacgaactttttttttttttttttagtctcaa

SEQ ID NO: 8241 - DNA, 32 bp, Artificial Sequence
  Synthetic polynucleotide
ttttttttagagcataaattcgcttttttttt

SEQ ID NO: 8242 - DNA, 32 bp, Artificial Sequence
  Synthetic polynucleotide
gaagatagttttttttttttttttaaaccgga

SEQ ID NO: 8243 - DNA, 32 bp, Artificial Sequence
  Synthetic polynucleotide
ttttttttcgcatctcactcagtgtttttttt

SEQ ID NO: 8244 - DNA, 32 bp, Artificial Sequence
  Synthetic polynucleotide
aaagtatcttttttttttttttttatcgagta

SEQ ID NO: 8245 - DNA, 32 bp, Artificial Sequence
  Synthetic polynucleotide
ttttttttgccttttcgaacggtgtttttttt

SEQ ID NO: 8246 - DNA, 32 bp, Artificial Sequence
  Synthetic polynucleotide
ttcatgtcttttttttttttttttacacactt

SEQ ID NO: 8247 - DNA, 32 bp, Artificial Sequence
  Synthetic polynucleotide
tttttttttcagagtagcggaaattttttttt

SEQ ID NO: 8248 - DNA, 32 bp, Artificial Sequence
  Synthetic polynucleotide
gtgttcatttttttttttttttttatggccgc

SEQ ID NO: 8249 - DNA, 32 bp, Artificial Sequence
  Synthetic polynucleotide
ttttttttgcagcgggccgcctgttttttttt

SEQ ID NO: 8250 - DNA, 32 bp, Artificial Sequence
  Synthetic polynucleotide
ttcggtgcttttttttttttttttaacgctta

SEQ ID NO: 8251 - DNA, 32 bp, Artificial Sequence
  Synthetic polynucleotide
ttttttttgggcttttgctaatactttttttt

SEQ ID NO: 8252 - DNA, 32 bp, Artificial Sequence
  Synthetic polynucleotide
atcagcccttttttttttttttttgctgagcg

SEQ ID NO: 8253 - DNA, 32 bp, Artificial Sequence
  Synthetic polynucleotide
ttttttttgttgcggggtttctgatttttttt

SEQ ID NO: 8254 - DNA, 32 bp, Artificial Sequence
  Synthetic polynucleotide
atgctgttttttttttttttttttaccggaac

SEQ ID NO: 8255 - DNA, 32 bp, Artificial Sequence
  Synthetic polynucleotide
ttttttttatgaagccgtgacccctttttttt

SEQ ID NO: 8256 - DNA, 32 bp, Artificial Sequence
  Synthetic polynucleotide
ccgggctattttttttttttttttagagactg

SEQ ID NO: 8257 - DNA, 32 bp, Artificial Sequence; identical to SEQ ID NO: 5624
  Synthetic polynucleotide

SEQ ID NO: 8258 - DNA, 32 bp, Artificial Sequence
  Synthetic polynucleotide
tctgatgcttttttttttttttttttagctgt

SEQ ID NO: 8259 - DNA, 32 bp, Artificial Sequence
  Synthetic polynucleotide
ttttttttgatcgcgagttccctctttttttt

SEQ ID NO: 8260 - DNA, 32 bp, Artificial Sequence
  Synthetic polynucleotide
gtcagtgttttttttttttttttttagctagg

SEQ ID NO: 8261 - DNA, 32 bp, Artificial Sequence
  Synthetic polynucleotide
ttttttttaaaagggtggatatggtttttttt

SEQ ID NO: 8262 - DNA, 32 bp, Artificial Sequence
  Synthetic polynucleotide
gtgatgccttttttttttttttttagctggaa

SEQ ID NO: 8263 - DNA, 32 bp, Artificial Sequence
  Synthetic polynucleotide
ttttttttatttctagtgacctggtttttttt

SEQ ID NO: 8264 - DNA, 32 bp, Artificial Sequence
  Synthetic polynucleotide
cggctctgtttttttttttttttttataatgg

SEQ ID NO: 8265 - DNA, 32 bp, Artificial Sequence
  Synthetic polynucleotide
ttttttttcctgacctcaatcatatttttttt

SEQ ID NO: 8266 - DNA, 32 bp, Artificial Sequence
  Synthetic polynucleotide
cggagctattttttttttttttttcgtcccac

SEQ ID NO: 8267 - DNA, 32 bp, Artificial Sequence
  Synthetic polynucleotide
tttttttttcatcccctttaagaatttttttt

SEQ ID NO: 8268 - DNA, 32 bp, Artificial Sequence
  Synthetic polynucleotide
ggaaggattttttttttttttttttgatcgca

SEQ ID NO: 8269 - DNA, 32 bp, Artificial Sequence
  Synthetic polynucleotide
ttttttttgagatgttgaacatcttttttttt

SEQ ID NO: 8270 - DNA, 32 bp, Artificial Sequence
  Synthetic polynucleotide
cagtcttttttttttttttttttttttggttg

SEQ ID NO: 8271 - DNA, 32 bp, Artificial Sequence
  Synthetic polynucleotide
ttttttttatctcgcattctggtgtttttttt

SEQ ID NO: 8272 - DNA, 32 bp, Artificial Sequence
  Synthetic polynucleotide
gcgtaaagttttttttttttttttccaaaact

SEQ ID NO: 8273 - DNA, 32 bp, Artificial Sequence
  Synthetic polynucleotide
ttttttttgttcaagcactattattttttttt

SEQ ID NO: 8274 - DNA, 32 bp, Artificial Sequence
  Synthetic polynucleotide
gccgactcttttttttttttttttctggctat

SEQ ID NO: 8275 - DNA, 32 bp, Artificial Sequence
  Synthetic polynucleotide
tttttttttctgtcagcccaagcttttttttt

SEQ ID NO: 8276 - DNA, 32 bp, Artificial Sequence
  Synthetic polynucleotide
aaaagatgtttttttttttttttttagcataa

SEQ ID NO: 8277 - DNA, 32 bp, Artificial Sequence
  Synthetic polynucleotide
ttttttttacgaccccgccgtgcgtttttttt

SEQ ID NO: 8278 - DNA, 32 bp, Artificial Sequence
  Synthetic polynucleotide
gcggctggttttttttttttttttacgactga

SEQ ID NO: 8279 - DNA, 32 bp, Artificial Sequence
  Synthetic polynucleotide
ttttttttcatatcctcggcccgctttttttt

SEQ ID NO: 8280 - DNA, 32 bp, Artificial Sequence
  Synthetic polynucleotide
gacaaacgttttttttttttttttcaaattaa

SEQ ID NO: 8281 - DNA, 32 bp, Artificial Sequence
  Synthetic polynucleotide
ttttttttgtccttccacggtaattttttttt

SEQ ID NO: 8282 - DNA, 32 bp, Artificial Sequence
  Synthetic polynucleotide
gcctaaagttttttttttttttttcgggggtg

SEQ ID NO: 8283 - DNA, 32 bp, Artificial Sequence
  Synthetic polynucleotide
tttttttttcgaacgaggactgtttttttttt

SEQ ID NO: 8284 - DNA, 32 bp, Artificial Sequence
  Synthetic polynucleotide
acgactcgttttttttttttttttctacatag

SEQ ID NO: 8285 - DNA, 32 bp, Artificial Sequence
  Synthetic polynucleotide
ttttttttacgaggtttcactgggtttttttt

SEQ ID NO: 8286 - DNA, 32 bp, Artificial Sequence
  Synthetic polynucleotide
tgacttggttttttttttttttttcgctatac

SEQ ID NO: 8287 - DNA, 32 bp, Artificial Sequence
  Synthetic polynucleotide
ttttttttcgaggggctccctgtctttttttt

SEQ ID NO: 8288 - DNA, 32 bp, Artificial Sequence
  Synthetic polynucleotide
aggaaacttttttttttttttttttgtcgagc

SEQ ID NO: 8289 - DNA, 32 bp, Artificial Sequence
  Synthetic polynucleotide
ttttttttcacttctggagaaagatttttttt

SEQ ID NO: 8290 - DNA, 32 bp, Artificial Sequence
  Synthetic polynucleotide
ccagcgactttttttttttttttttgcggtgg

SEQ ID NO: 8291 - DNA, 32 bp, Artificial Sequence
  Synthetic polynucleotide
ttttttttgtgattagcttgggggtttttttt

SEQ ID NO: 8292 - DNA, 32 bp, Artificial Sequence
  Synthetic polynucleotide
cagtagtttttttttttttttttttgatatac

SEQ ID NO: 8293 - DNA, 32 bp, Artificial Sequence
  Synthetic polynucleotide
ttttttttactccttctaatgtgatttttttt

SEQ ID NO: 8294 - DNA, 32 bp, Artificial Sequence
  Synthetic polynucleotide
ctcactaattttttttttttttttctaagcgt

SEQ ID NO: 8295 - DNA, 32 bp, Artificial Sequence
  Synthetic polynucleotide
ttttttttaaggaaaccagctatctttttttt

SEQ ID NO: 8296 - DNA, 32 bp, Artificial Sequence
  Synthetic polynucleotide
taactccattttttttttttttttccatattc

SEQ ID NO: 8297 - DNA, 32 bp, Artificial Sequence
  Synthetic polynucleotide
ttttttttcggacatctatgcgcctttttttt

SEQ ID NO: 8298 - DNA, 32 bp, Artificial Sequence
  Synthetic polynucleotide
gatgtaagttttttttttttttttcgatatcc

SEQ ID NO: 8299 - DNA, 32 bp, Artificial Sequence
  Synthetic polynucleotide
tttttttttagggggcttctgacctttttttt

SEQ ID NO: 8300 - DNA, 32 bp, Artificial Sequence
  Synthetic polynucleotide
gttcaaacttttttttttttttttaaagctca

SEQ ID NO: 8301 - DNA, 32 bp, Artificial Sequence
  Synthetic polynucleotide
ttttttttgtaaacaggaacagcttttttttt

SEQ ID NO: 8302 - DNA, 32 bp, Artificial Sequence
  Synthetic polynucleotide
tgagaatttttttttttttttttttagagcag

SEQ ID NO: 8303 - DNA, 32 bp, Artificial Sequence
  Synthetic polynucleotide
ttttttttggatacgctacctatgtttttttt

SEQ ID NO: 8304 - DNA, 32 bp, Artificial Sequence
  Synthetic polynucleotide
tcaagttcttttttttttttttttgacgggga

SEQ ID NO: 8305 - DNA, 32 bp, Artificial Sequence
  Synthetic polynucleotide
ttttttttaccatgatccggatgatttttttt

SEQ ID NO: 8306 - DNA, 32 bp, Artificial Sequence
  Synthetic polynucleotide
tatgcgacttttttttttttttttgttatgaa

SEQ ID NO: 8307 - DNA, 32 bp, Artificial Sequence
  Synthetic polynucleotide
ttttttttttgggatatacaatcttttttttt

SEQ ID NO: 8308 - DNA, 32 bp, Artificial Sequence
  Synthetic polynucleotide
gatcgtcattttttttttttttttcgaagtaa

SEQ ID NO: 8309 - DNA, 32 bp, Artificial Sequence
  Synthetic polynucleotide
ttttttttaccctgcgaagataggtttttttt

SEQ ID NO: 8310 - DNA, 32 bp, Artificial Sequence
  Synthetic polynucleotide
agcatagcttttttttttttttttgtcacagc

SEQ ID NO: 8311 - DNA, 32 bp, Artificial Sequence
  Synthetic polynucleotide
ttttttttctctaccttgttggactttttttt

SEQ ID NO: 8312 - DNA, 32 bp, Artificial Sequence
  Synthetic polynucleotide
agtaatacttttttttttttttttgtaagcgt

SEQ ID NO: 8313 - DNA, 32 bp, Artificial Sequence
  Synthetic polynucleotide
ttttttttgaccagaaagcacgagtttttttt

SEQ ID NO: 8314 - DNA, 32 bp, Artificial Sequence
  Synthetic polynucleotide
gaaataacttttttttttttttttgattatca

SEQ ID NO: 8315 - DNA, 32 bp, Artificial Sequence
  Synthetic polynucleotide
tttttttttcgaaataatcgttagtttttttt

SEQ ID NO: 8316 - DNA, 32 bp, Artificial Sequence
  Synthetic polynucleotide
cgtgtacctttttttttttttttttttctcga

SEQ ID NO: 8317 - DNA, 32 bp, Artificial Sequence
  Synthetic polynucleotide
ttttttttaaacaggcagcggtagtttttttt

SEQ ID NO: 8318 - DNA, 32 bp, Artificial Sequence
  Synthetic polynucleotide
ctgttccgttttttttttttttttcctcccac

SEQ ID NO: 8319 - DNA, 32 bp, Artificial Sequence
  Synthetic polynucleotide
tttttttttgccttggtaactgattttttttt

SEQ ID NO: 8320 - DNA, 32 bp, Artificial Sequence
  Synthetic polynucleotide
ttaacctatttttttttttttttttttctcct

SEQ ID NO: 8321 - DNA, 32 bp, Artificial Sequence
  Synthetic polynucleotide
tttttttttagctgatctatggtctttttttt

SEQ ID NO: 8322 - DNA, 32 bp, Artificial Sequence
  Synthetic polynucleotide
ggttccgcttttttttttttttttcttaatat

SEQ ID NO: 8323 - DNA, 32 bp, Artificial Sequence
  Synthetic polynucleotide
ttttttttgtgaaacaggccaccttttttttt

SEQ ID NO: 8324 - DNA, 32 bp, Artificial Sequence
  Synthetic polynucleotide
gggagaggttttttttttttttttggctcggg

SEQ ID NO: 8325 - DNA, 32 bp, Artificial Sequence
  Synthetic polynucleotide
ttttttttggttatactcgtcaagtttttttt

SEQ ID NO: 8326 - DNA, 32 bp, Artificial Sequence
  Synthetic polynucleotide
gccgcctcttttttttttttttttcctgcttt

SEQ ID NO: 8327 - DNA, 32 bp, Artificial Sequence
  Synthetic polynucleotide
ttttttttgtgcccgagcgtctgatttttttt

SEQ ID NO: 8328 - DNA, 32 bp, Artificial Sequence
  Synthetic polynucleotide
acgtgggattttttttttttttttggtatggt

SEQ ID NO: 8329 - DNA, 32 bp, Artificial Sequence
  Synthetic polynucleotide
tttttttttatgttgtctcaagtgtttttttt

SEQ ID NO: 8330 - DNA, 32 bp, Artificial Sequence
  Synthetic polynucleotide
ttacccacttttttttttttttttctaacagt

SEQ ID NO: 8331 - DNA, 32 bp, Artificial Sequence
  Synthetic polynucleotide
tttttttttccataactgtgcacgtttttttt

SEQ ID NO: 8332 - DNA, 32 bp, Artificial Sequence
  Synthetic polynucleotide
actaattatttttttttttttttttcagggat

SEQ ID NO: 8333 - DNA, 32 bp, Artificial Sequence
  Synthetic polynucleotide
ttttttttgtggccgttgctacattttttttt

SEQ ID NO: 8334 - DNA, 32 bp, Artificial Sequence
  Synthetic polynucleotide
tctcaccgttttttttttttttttcagtttct

SEQ ID NO: 8335 - DNA, 32 bp, Artificial Sequence
  Synthetic polynucleotide
ttttttttctggggaaactatacttttttttt

SEQ ID NO: 8336 - DNA, 32 bp, Artificial Sequence
  Synthetic polynucleotide
ttgcactctttttttttttttttttacgcact

SEQ ID NO: 8337 - DNA, 32 bp, Artificial Sequence
  Synthetic polynucleotide
ttttttttgggattaggcaattgctttttttt

SEQ ID NO: 8338 - DNA, 32 bp, Artificial Sequence
  Synthetic polynucleotide
ggtttggatttttttttttttttttaggttgc

SEQ ID NO: 8339 - DNA, 32 bp, Artificial Sequence
  Synthetic polynucleotide
ttttttttcacaatttttgattcgtttttttt

SEQ ID NO: 8340 - DNA, 32 bp, Artificial Sequence
  Synthetic polynucleotide
attgtaggttttttttttttttttatcacata

SEQ ID NO: 8341 - DNA, 32 bp, Artificial Sequence
  Synthetic polynucleotide
ttttttttataaagctgtagcctgtttttttt

SEQ ID NO: 8342 - DNA, 32 bp, Artificial Sequence
  Synthetic polynucleotide
catgggcattttttttttttttttaggcgcgc

SEQ ID NO: 8343 - DNA, 32 bp, Artificial Sequence
  Synthetic polynucleotide
ttttttttcgtgtcaccttgatattttttttt

SEQ ID NO: 8344 - DNA, 32 bp, Artificial Sequence
  Synthetic polynucleotide
agctgcactttttttttttttttttgagggac

SEQ ID NO: 8345 - DNA, 32 bp, Artificial Sequence
  Synthetic polynucleotide
ttttttttattcggataaaccatatttttttt

SEQ ID NO: 8346 - DNA, 32 bp, Artificial Sequence
  Synthetic polynucleotide
acctcgtcttttttttttttttttctgagggc

SEQ ID NO: 8347 - DNA, 32 bp, Artificial Sequence
  Synthetic polynucleotide
ttttttttagatcggctaatcatttttttttt

SEQ ID NO: 8348 - DNA, 32 bp, Artificial Sequence
  Synthetic polynucleotide
agtgggcgttttttttttttttttagtgctcc

SEQ ID NO: 8349 - DNA, 32 bp, Artificial Sequence
  Synthetic polynucleotide
ttttttttgttcatagttcattagtttttttt

SEQ ID NO: 8350 - DNA, 32 bp, Artificial Sequence
  Synthetic polynucleotide
cttagttattttttttttttttttgggcggaa

SEQ ID NO: 8351 - DNA, 32 bp, Artificial Sequence
  Synthetic polynucleotide
ttttttttgtgccccacgtacagttttttttt

SEQ ID NO: 8352 - DNA, 32 bp, Artificial Sequence
  Synthetic polynucleotide
atgggctgttttttttttttttttaaccaacc

SEQ ID NO: 8353 - DNA, 32 bp, Artificial Sequence
  Synthetic polynucleotide
tttttttttgtgggtagggccgagtttttttt

SEQ ID NO: 8354 - DNA, 32 bp, Artificial Sequence
  Synthetic polynucleotide
ggtgtaccttttttttttttttttcgctgggc

SEQ ID NO: 8355 - DNA, 32 bp, Artificial Sequence
  Synthetic polynucleotide
ttttttttgcaagtgaaatatatgtttttttt

SEQ ID NO: 8356 - DNA, 32 bp, Artificial Sequence
  Synthetic polynucleotide
ttacatgtttttttttttttttttacttggtc

SEQ ID NO: 8357 - DNA, 32 bp, Artificial Sequence
  Synthetic polynucleotide
ttttttttctgctagaaaccaccatttttttt

SEQ ID NO: 8358 - DNA, 32 bp, Artificial Sequence
  Synthetic polynucleotide
gaccagatttttttttttttttttacatcctc

SEQ ID NO: 8359 - DNA, 32 bp, Artificial Sequence
  Synthetic polynucleotide
ttttttttctttcaatttttagtatttttttt

SEQ ID NO: 8360 - DNA, 32 bp, Artificial Sequence
  Synthetic polynucleotide
cttgacacttttttttttttttttaacaccca

SEQ ID NO: 8361 - DNA, 32 bp, Artificial Sequence
  Synthetic polynucleotide
ttttttttgaacttcccatggtcgtttttttt

SEQ ID NO: 8362 - DNA, 32 bp, Artificial Sequence
  Synthetic polynucleotide
acagagctttttttttttttttttttctactg

SEQ ID NO: 8363 - DNA, 32 bp, Artificial Sequence
  Synthetic polynucleotide
tttttttttcataggatcaaactatttttttt

SEQ ID NO: 8364 - DNA, 32 bp, Artificial Sequence
  Synthetic polynucleotide
tcgtatgattttttttttttttttaatacagc

SEQ ID NO: 8365 - DNA, 32 bp, Artificial Sequence
  Synthetic polynucleotide
ttttttttagttcttgtccttatttttttttt

SEQ ID NO: 8366 - DNA, 32 bp, Artificial Sequence
  Synthetic polynucleotide
gtaccgccttttttttttttttttggcgatcg

SEQ ID NO: 8367 - DNA, 32 bp, Artificial Sequence
  Synthetic polynucleotide
ttttttttaatgtttgatggccgctttttttt

SEQ ID NO: 8368 - DNA, 32 bp, Artificial Sequence
  Synthetic polynucleotide
tgcattccttttttttttttttttgtggctta

SEQ ID NO: 8369 - DNA, 32 bp, Artificial Sequence
  Synthetic polynucleotide
ttttttttaaagtcgtccgcctcctttttttt

SEQ ID NO: 8370 - DNA, 32 bp, Artificial Sequence
  Synthetic polynucleotide
aaccacatttttttttttttttttggtagtca

SEQ ID NO: 8371 - DNA, 32 bp, Artificial Sequence
  Synthetic polynucleotide
ttttttttctatacccgacaaaaatttttttt

SEQ ID NO: 8372 - DNA, 32 bp, Artificial Sequence
  Synthetic polynucleotide
cagaaagtttttttttttttttttcagatttg

SEQ ID NO: 8373 - DNA, 32 bp, Artificial Sequence
  Synthetic polynucleotide
tttttttttgcgggggggtcgagctttttttt

SEQ ID NO: 8374 - DNA, 32 bp, Artificial Sequence
  Synthetic polynucleotide
tatactctttttttttttttttttgctccact

SEQ ID NO: 8375 - DNA, 32 bp, Artificial Sequence
  Synthetic polynucleotide
ttttttttcggccatcgtggactatttttttt

SEQ ID NO: 8376 - DNA, 32 bp, Artificial Sequence
  Synthetic polynucleotide
gtagtggcttttttttttttttttgaaagcgc

SEQ ID NO: 8377 - DNA, 32 bp, Artificial Sequence
  Synthetic polynucleotide
tttttttttgaatatcgctacctctttttttt

SEQ ID NO: 8378 - DNA, 32 bp, Artificial Sequence
  Synthetic polynucleotide
cggcaatcttttttttttttttttcgatacgc

SEQ ID NO: 8379 - DNA, 32 bp, Artificial Sequence
  Synthetic polynucleotide
ttttttttaccatttaagagtaggtttttttt

SEQ ID NO: 8380 - DNA, 32 bp, Artificial Sequence
  Synthetic polynucleotide
gaaccagattttttttttttttttggcagtgc

SEQ ID NO: 8381 - DNA, 32 bp, Artificial Sequence
  Synthetic polynucleotide
ttttttttacagtgggacatctcgtttttttt

SEQ ID NO: 8382 - DNA, 32 bp, Artificial Sequence
  Synthetic polynucleotide
tcagccaattttttttttttttttgaaaggtg

SEQ ID NO: 8383 - DNA, 32 bp, Artificial Sequence
  Synthetic polynucleotide
ttttttttgcaagtaaaaaaggaatttttttt

SEQ ID NO: 8384 - DNA, 32 bp, Artificial Sequence
  Synthetic polynucleotide
tcccaagtttttttttttttttttttatgaga

SEQ ID NO: 8385 - DNA, 32 bp, Artificial Sequence
  Synthetic polynucleotide
ttttttttgatcctaaagtttctgtttttttt

SEQ ID NO: 8386 - DNA, 32 bp, Artificial Sequence
  Synthetic polynucleotide
tcatgtggttttttttttttttttgtagacct

SEQ ID NO: 8387 - DNA, 32 bp, Artificial Sequence
  Synthetic polynucleotide
ttttttttagagcggtgatatccatttttttt

SEQ ID NO: 8388 - DNA, 32 bp, Artificial Sequence
  Synthetic polynucleotide
cgtaggctttttttttttttttttcggtacat

SEQ ID NO: 8389 - DNA, 32 bp, Artificial Sequence
  Synthetic polynucleotide
tttttttttgcacggaacgagagttttttttt

SEQ ID NO: 8390 - DNA, 32 bp, Artificial Sequence
  Synthetic polynucleotide
tcgtttacttttttttttttttttgctggcat

SEQ ID NO: 8391 - DNA, 32 bp, Artificial Sequence
  Synthetic polynucleotide
ttttttttgaaacctaacttggggtttttttt

SEQ ID NO: 8392 - DNA, 32 bp, Artificial Sequence
  Synthetic polynucleotide
aagcaagattttttttttttttttactaagat

SEQ ID NO: 8393 - DNA, 32 bp, Artificial Sequence
  Synthetic polynucleotide
ttttttttattttcgcgcgattcgtttttttt

SEQ ID NO: 8394 - DNA, 32 bp, Artificial Sequence
  Synthetic polynucleotide
cgttgcgattttttttttttttttcatgtagc

SEQ ID NO: 8395 - DNA, 32 bp, Artificial Sequence
  Synthetic polynucleotide
ttttttttatcgtcctagacgacgtttttttt

SEQ ID NO: 8396 - DNA, 32 bp, Artificial Sequence
  Synthetic polynucleotide
cgaacgagttttttttttttttttgatctcct

SEQ ID NO: 8397 - DNA, 32 bp, Artificial Sequence
  Synthetic polynucleotide
ttttttttgtagcaccgtcaaatatttttttt

SEQ ID NO: 8398 - DNA, 32 bp, Artificial Sequence
  Synthetic polynucleotide
gcatgccgtttttttttttttttttgcgtgct

SEQ ID NO: 8399 - DNA, 32 bp, Artificial Sequence
  Synthetic polynucleotide
tttttttttttagacccagcttgatttttttt

SEQ ID NO: 8400 - DNA, 32 bp, Artificial Sequence
  Synthetic polynucleotide
tttaacgcttttttttttttttttcgcaagac

SEQ ID NO: 8401 - DNA, 32 bp, Artificial Sequence
  Synthetic polynucleotide
ttttttttctgggcagggtcctagtttttttt

SEQ ID NO: 8402 - DNA, 32 bp, Artificial Sequence
  Synthetic polynucleotide
gctaatcattttttttttttttttgttgcaga

SEQ ID NO: 8403 - DNA, 32 bp, Artificial Sequence
  Synthetic polynucleotide
ttttttttccctaagcagcgtagttttttttt

SEQ ID NO: 8404 - DNA, 32 bp, Artificial Sequence
  Synthetic polynucleotide
aacctaccttttttttttttttttaagggtta

SEQ ID NO: 8405 - DNA, 32 bp, Artificial Sequence
  Synthetic polynucleotide
tttttttttgcggcggctgtacgatttttttt

SEQ ID NO: 8406 - DNA, 32 bp, Artificial Sequence
  Synthetic polynucleotide
caagttccttttttttttttttttatgagtcc

SEQ ID NO: 8407 - DNA, 32 bp, Artificial Sequence
  Synthetic polynucleotide
ttttttttcatgacattctcccactttttttt

SEQ ID NO: 8408 - DNA, 32 bp, Artificial Sequence
  Synthetic polynucleotide
ggccttgattttttttttttttttccgtccaa

SEQ ID NO: 8409 - DNA, 32 bp, Artificial Sequence
  Synthetic polynucleotide
ttttttttggatgtcgagcccacatttttttt

SEQ ID NO: 8410 - DNA, 32 bp, Artificial Sequence
  Synthetic polynucleotide
caccagcattttttttttttttttacttgaca

SEQ ID NO: 8411 - DNA, 32 bp, Artificial Sequence
  Synthetic polynucleotide
ttttttttgtatcttttttcatggtttttttt

SEQ ID NO: 8412 - DNA, 32 bp, Artificial Sequence
  Synthetic polynucleotide
gtagtacattttttttttttttttcggcgatg

SEQ ID NO: 8413 - DNA, 32 bp, Artificial Sequence
  Synthetic polynucleotide
ttttttttgcttttatatagcgtatttttttt

SEQ ID NO: 8414 - DNA, 32 bp, Artificial Sequence
  Synthetic polynucleotide
tgcgtacgttttttttttttttttgaccggac

SEQ ID NO: 8415 - DNA, 32 bp, Artificial Sequence
  Synthetic polynucleotide
tttttttttatgccccccggttcttttttttt

SEQ ID NO: 8416 - DNA, 32 bp, Artificial Sequence
  Synthetic polynucleotide
agagtcgtttttttttttttttttgctagagt

SEQ ID NO: 8417 - DNA, 32 bp, Artificial Sequence
  Synthetic polynucleotide
ttttttttccaagtaacgtatgtatttttttt

SEQ ID NO: 8418 - DNA, 32 bp, Artificial Sequence
  Synthetic polynucleotide
cgcgcttattttttttttttttttcgacgcga

SEQ ID NO: 8419 - DNA, 32 bp, Artificial Sequence
  Synthetic polynucleotide
ttttttttaacgggtggatgaatttttttttt

SEQ ID NO: 8420 - DNA, 32 bp, Artificial Sequence
  Synthetic polynucleotide
tgcgagtgtttttttttttttttttcgttcgg

SEQ ID NO: 8421 - DNA, 32 bp, Artificial Sequence
  Synthetic polynucleotide
ttttttttgatctaagtctggcgctttttttt

SEQ ID NO: 8422 - DNA, 32 bp, Artificial Sequence
  Synthetic polynucleotide
ggccaggcttttttttttttttttgtgaggac

SEQ ID NO: 8423 - DNA, 32 bp, Artificial Sequence
  Synthetic polynucleotide
tttttttttgaagtaggaagcttttttttttt

SEQ ID NO: 8424 - DNA, 32 bp, Artificial Sequence
  Synthetic polynucleotide
acgtaagtttttttttttttttttttctagcc

SEQ ID NO: 8425 - DNA, 32 bp, Artificial Sequence
  Synthetic polynucleotide
ttttttttgacactacgacctgcttttttttt

SEQ ID NO: 8426 - DNA, 32 bp, Artificial Sequence
  Synthetic polynucleotide
atagcatctttttttttttttttttttcgaca

SEQ ID NO: 8427 - DNA, 32 bp, Artificial Sequence
  Synthetic polynucleotide
ttttttttattctggacagtaacttttttttt

SEQ ID NO: 8428 - DNA, 32 bp, Artificial Sequence
  Synthetic polynucleotide
cggactgcttttttttttttttttgcattaac

SEQ ID NO: 8429 - DNA, 32 bp, Artificial Sequence; identical to SEQ ID NO: 5629
  Synthetic polynucleotide

SEQ ID NO: 8430 - DNA, 32 bp, Artificial Sequence
  Synthetic polynucleotide
tacgtgcttttttttttttttttttcctcagc

SEQ ID NO: 8431 - DNA, 32 bp, Artificial Sequence
  Synthetic polynucleotide
ttttttttattatctcgataagcatttttttt

SEQ ID NO: 8432 - DNA, 32 bp, Artificial Sequence
  Synthetic polynucleotide
agttgaaattttttttttttttttgaaggacc

SEQ ID NO: 8433 - DNA, 32 bp, Artificial Sequence
  Synthetic polynucleotide
tttttttttggcaagagacaaggctttttttt

SEQ ID NO: 8434 - DNA, 32 bp, Artificial Sequence
  Synthetic polynucleotide
tgtataacttttttttttttttttcgcttcag

SEQ ID NO: 8435 - DNA, 32 bp, Artificial Sequence
  Synthetic polynucleotide
ttttttttgccggaccgtattaattttttttt

SEQ ID NO: 8436 - DNA, 32 bp, Artificial Sequence
  Synthetic polynucleotide
aaaggatattttttttttttttttgccgcgcc

SEQ ID NO: 8437 - DNA, 32 bp, Artificial Sequence
  Synthetic polynucleotide
ttttttttcccggacctagtgtcttttttttt

SEQ ID NO: 8438 - DNA, 32 bp, Artificial Sequence
  Synthetic polynucleotide
aacggtttttttttttttttttttatcaagtc

SEQ ID NO: 8439 - DNA, 32 bp, Artificial Sequence
  Synthetic polynucleotide
ttttttttgaaaccattctcgggttttttttt

SEQ ID NO: 8440 - DNA, 32 bp, Artificial Sequence
  Synthetic polynucleotide
tattctatttttttttttttttttcgagcggg

SEQ ID NO: 8441 - DNA, 32 bp, Artificial Sequence
  Synthetic polynucleotide
ttttttttgtgacctacgagaagctttttttt

SEQ ID NO: 8442 - DNA, 32 bp, Artificial Sequence
  Synthetic polynucleotide
tcactgttttttttttttttttttgtatagat

SEQ ID NO: 8443 - DNA, 32 bp, Artificial Sequence
  Synthetic polynucleotide
ttttttttcgaatagctcacaggctttttttt

SEQ ID NO: 8444 - DNA, 32 bp, Artificial Sequence
  Synthetic polynucleotide
gttccgcgttttttttttttttttgaactacg

SEQ ID NO: 8445 - DNA, 32 bp, Artificial Sequence
  Synthetic polynucleotide
ttttttttggtttaaacgctcctctttttttt

SEQ ID NO: 8446 - DNA, 32 bp, Artificial Sequence
  Synthetic polynucleotide
tatgaattttttttttttttttttgggaatta

SEQ ID NO: 8447 - DNA, 32 bp, Artificial Sequence
  Synthetic polynucleotide
ttttttttggtggcaaaccacctctttttttt

SEQ ID NO: 8448 - DNA, 32 bp, Artificial Sequence
  Synthetic polynucleotide
atacgacattttttttttttttttcgatgtca

SEQ ID NO: 8449 - DNA, 32 bp, Artificial Sequence
  Synthetic polynucleotide
tttttttttacccattcactgtgatttttttt

SEQ ID NO: 8450 - DNA, 32 bp, Artificial Sequence
  Synthetic polynucleotide
gcgccgcattttttttttttttttatttccac

SEQ ID NO: 8451 - DNA, 32 bp, Artificial Sequence
  Synthetic polynucleotide
ttttttttttcgcaggtccatgggtttttttt

SEQ ID NO: 8452 - DNA, 32 bp, Artificial Sequence
  Synthetic polynucleotide
accgaggattttttttttttttttattcacca

SEQ ID NO: 8453 - DNA, 32 bp, Artificial Sequence
  Synthetic polynucleotide
tttttttttacaccctgattctcctttttttt

SEQ ID NO: 8454 - DNA, 32 bp, Artificial Sequence
  Synthetic polynucleotide
agctcgtattttttttttttttttatggcagc

SEQ ID NO: 8455 - DNA, 32 bp, Artificial Sequence
  Synthetic polynucleotide
ttttttttacaggtctgaactggttttttttt

SEQ ID NO: 8456 - DNA, 32 bp, Artificial Sequence
  Synthetic polynucleotide
gcttcggtttttttttttttttttagatcacc

SEQ ID NO: 8457 - DNA, 32 bp, Artificial Sequence; identical to SEQ ID NO: 5630
  Synthetic polynucleotide

SEQ ID NO: 8458 - DNA, 32 bp, Artificial Sequence
  Synthetic polynucleotide
attagtgtttttttttttttttttcccttgtg

SEQ ID NO: 8459 - DNA, 32 bp, Artificial Sequence
  Synthetic polynucleotide
tttttttttaatgctgttccggggtttttttt

SEQ ID NO: 8460 - DNA, 32 bp, Artificial Sequence
  Synthetic polynucleotide
tcgtcgtgtttttttttttttttttaaatcaa

SEQ ID NO: 8461 - DNA, 32 bp, Artificial Sequence
  Synthetic polynucleotide
ttttttttttccaaactttagagctttttttt

SEQ ID NO: 8462 - DNA, 32 bp, Artificial Sequence
  Synthetic polynucleotide
acgctctgttttttttttttttttccggccgt

SEQ ID NO: 8463 - DNA, 32 bp, Artificial Sequence
  Synthetic polynucleotide
ttttttttatacgagcgtggagggtttttttt

SEQ ID NO: 8464 - DNA, 32 bp, Artificial Sequence
  Synthetic polynucleotide
acccaatcttttttttttttttttaagttatt

SEQ ID NO: 8465 - DNA, 32 bp, Artificial Sequence
  Synthetic polynucleotide
ttttttttgttttcatatatcagatttttttt

SEQ ID NO: 8466 - DNA, 32 bp, Artificial Sequence
  Synthetic polynucleotide
ctactggcttttttttttttttttgagcacag

SEQ ID NO: 8467 - DNA, 32 bp, Artificial Sequence
  Synthetic polynucleotide
ttttttttagcccggcgtattatctttttttt

SEQ ID NO: 8468 - DNA, 32 bp, Artificial Sequence
  Synthetic polynucleotide
taattcggttttttttttttttttgcgtcaat

SEQ ID NO: 8469 - DNA, 32 bp, Artificial Sequence
  Synthetic polynucleotide
ttttttttacacaccagattacggtttttttt

SEQ ID NO: 8470 - DNA, 32 bp, Artificial Sequence
  Synthetic polynucleotide
tcatatggttttttttttttttttcggcttag

SEQ ID NO: 8471 - DNA, 32 bp, Artificial Sequence
  Synthetic polynucleotide
ttttttttagtacaagtgacgaagtttttttt

SEQ ID NO: 8472 - DNA, 32 bp, Artificial Sequence
  Synthetic polynucleotide
gggaattgttttttttttttttttaataccgt

SEQ ID NO: 8473 - DNA, 32 bp, Artificial Sequence
  Synthetic polynucleotide
tttttttttggagctgtcaggctttttttttt

SEQ ID NO: 8474 - DNA, 32 bp, Artificial Sequence
  Synthetic polynucleotide
ccatcagattttttttttttttttctccgtca

SEQ ID NO: 8475 - DNA, 32 bp, Artificial Sequence
  Synthetic polynucleotide
ttttttttgctgagattgattggttttttttt

SEQ ID NO: 8476 - DNA, 32 bp, Artificial Sequence
  Synthetic polynucleotide
aaatgttgttttttttttttttttttagtgta

SEQ ID NO: 8477 - DNA, 32 bp, Artificial Sequence
  Synthetic polynucleotide
ttttttttaagagatatgtgggagtttttttt

SEQ ID NO: 8478 - DNA, 32 bp, Artificial Sequence
  Synthetic polynucleotide
tagcgagtttttttttttttttttgatcatta

SEQ ID NO: 8479 - DNA, 32 bp, Artificial Sequence
  Synthetic polynucleotide
ttttttttaagttgactagcagaatttttttt

SEQ ID NO: 8480 - DNA, 32 bp, Artificial Sequence
  Synthetic polynucleotide
caggatcatttttttttttttttttaatttgc

SEQ ID NO: 8481 - DNA, 32 bp, Artificial Sequence
  Synthetic polynucleotide
ttttttttaaggtacgcaattacttttttttt

SEQ ID NO: 8482 - DNA, 32 bp, Artificial Sequence
  Synthetic polynucleotide
atccgaatttttttttttttttttatttgtac

SEQ ID NO: 8483 - DNA, 32 bp, Artificial Sequence
  Synthetic polynucleotide
ttttttttagggcatacagtaacgtttttttt

SEQ ID NO: 8484 - DNA, 32 bp, Artificial Sequence
  Synthetic polynucleotide
cgaaaacattttttttttttttttaaaagcga

SEQ ID NO: 8485 - DNA, 32 bp, Artificial Sequence
  Synthetic polynucleotide
ttttttttccacctagcacctccttttttttt

SEQ ID NO: 8486 - DNA, 32 bp, Artificial Sequence
  Synthetic polynucleotide
acgagccattttttttttttttttgttagggt

SEQ ID NO: 8487 - DNA, 32 bp, Artificial Sequence
  Synthetic polynucleotide
ttttttttggatgggttgttcatctttttttt

SEQ ID NO: 8488 - DNA, 32 bp, Artificial Sequence
  Synthetic polynucleotide
gacacccgttttttttttttttttggtcaccc

SEQ ID NO: 8489 - DNA, 32 bp, Artificial Sequence
  Synthetic polynucleotide
ttttttttgcttgaggaatagtcctttttttt

SEQ ID NO: 8490 - DNA, 32 bp, Artificial Sequence
  Synthetic polynucleotide
cagttttcttttttttttttttttaagaaatg

SEQ ID NO: 8491 - DNA, 32 bp, Artificial Sequence
  Synthetic polynucleotide
ttttttttaagttgtgccgcactgtttttttt

SEQ ID NO: 8492 - DNA, 32 bp, Artificial Sequence
  Synthetic polynucleotide
catgataattttttttttttttttgaatctga

SEQ ID NO: 8493 - DNA, 32 bp, Artificial Sequence
  Synthetic polynucleotide
ttttttttcggttctcgagacacttttttttt

SEQ ID NO: 8494 - DNA, 32 bp, Artificial Sequence
  Synthetic polynucleotide
agatgcacttttttttttttttttcatttact

SEQ ID NO: 8495 - DNA, 32 bp, Artificial Sequence
  Synthetic polynucleotide
ttttttttgaccatgtctccagtatttttttt

SEQ ID NO: 8496 - DNA, 32 bp, Artificial Sequence
  Synthetic polynucleotide
gctcggtattttttttttttttttttgccatt

SEQ ID NO: 8497 - DNA, 32 bp, Artificial Sequence
  Synthetic polynucleotide
ttttttttaatacttttaatataatttttttt

SEQ ID NO: 8498 - DNA, 32 bp, Artificial Sequence
  Synthetic polynucleotide
ttctaatttttttttttttttttttgtccgcg

SEQ ID NO: 8499 - DNA, 32 bp, Artificial Sequence
  Synthetic polynucleotide
ttttttttaattcgacacaatggttttttttt

SEQ ID NO: 8500 - DNA, 32 bp, Artificial Sequence
  Synthetic polynucleotide
gatcagcgttttttttttttttttatcttttg

SEQ ID NO: 8501 - DNA, 32 bp, Artificial Sequence
  Synthetic polynucleotide
ttttttttgtaaaccgcttgcctgtttttttt

SEQ ID NO: 8502 - DNA, 32 bp, Artificial Sequence
  Synthetic polynucleotide
aagcgcacttttttttttttttttggccaata

SEQ ID NO: 8503 - DNA, 32 bp, Artificial Sequence
  Synthetic polynucleotide
ttttttttctgacacccagctccctttttttt

SEQ ID NO: 8504 - DNA, 32 bp, Artificial Sequence
  Synthetic polynucleotide
atataggtttttttttttttttttaggtaagt

SEQ ID NO: 8505 - DNA, 32 bp, Artificial Sequence
  Synthetic polynucleotide
ttttttttacaatatgtattaagttttttttt

SEQ ID NO: 8506 - DNA, 32 bp, Artificial Sequence
  Synthetic polynucleotide
aatggtcgtttttttttttttttttttcgccg

SEQ ID NO: 8507 - DNA, 32 bp, Artificial Sequence
  Synthetic polynucleotide
tttttttttcttaatgtataattctttttttt

SEQ ID NO: 8508 - DNA, 32 bp, Artificial Sequence
  Synthetic polynucleotide
cttctaccttttttttttttttttatcctgtg

SEQ ID NO: 8509 - DNA, 32 bp, Artificial Sequence
  Synthetic polynucleotide
ttttttttcagagttcccatcggctttttttt

SEQ ID NO: 8510 - DNA, 32 bp, Artificial Sequence
  Synthetic polynucleotide
catggaagttttttttttttttttaaaattga

SEQ ID NO: 8511 - DNA, 32 bp, Artificial Sequence
  Synthetic polynucleotide
tttttttttataattaagaacatttttttttt

SEQ ID NO: 8512 - DNA, 32 bp, Artificial Sequence
  Synthetic polynucleotide
gttaccgcttttttttttttttttcgggttcg

SEQ ID NO: 8513 - DNA, 32 bp, Artificial Sequence
  Synthetic polynucleotide
tttttttttatgtgatcgcctaggtttttttt

SEQ ID NO: 8514 - DNA, 32 bp, Artificial Sequence
  Synthetic polynucleotide
acgtggtcttttttttttttttttctaacctc

SEQ ID NO: 8515 - DNA, 32 bp, Artificial Sequence; identical to SEQ ID NO: 5632
  Synthetic polynucleotide

SEQ ID NO: 8516 - DNA, 32 bp, Artificial Sequence
  Synthetic polynucleotide
atgactccttttttttttttttttctacgtgg

SEQ ID NO: 8517 - DNA, 32 bp, Artificial Sequence
  Synthetic polynucleotide
ttttttttatgccgagatctaacttttttttt

SEQ ID NO: 8518 - DNA, 32 bp, Artificial Sequence
  Synthetic polynucleotide
aagtgttatttttttttttttttttgattttt

SEQ ID NO: 8519 - DNA, 32 bp, Artificial Sequence
  Synthetic polynucleotide
tttttttttcgagaccttgctctttttttttt

SEQ ID NO: 8520 - DNA, 32 bp, Artificial Sequence
  Synthetic polynucleotide
attcagaattttttttttttttttggacgtct

SEQ ID NO: 8521 - DNA, 32 bp, Artificial Sequence
  Synthetic polynucleotide
ttttttttagcccgcggttactagtttttttt

SEQ ID NO: 8522 - DNA, 32 bp, Artificial Sequence
  Synthetic polynucleotide
cattctatttttttttttttttttgcgccttg

SEQ ID NO: 8523 - DNA, 32 bp, Artificial Sequence
  Synthetic polynucleotide
ttttttttctcaatagtgaacccttttttttt

SEQ ID NO: 8524 - DNA, 32 bp, Artificial Sequence
  Synthetic polynucleotide
ctcctacgtttttttttttttttttactatcg

SEQ ID NO: 8525 - DNA, 32 bp, Artificial Sequence
  Synthetic polynucleotide
tttttttttaggtcaaaataaacgtttttttt

SEQ ID NO: 8526 - DNA, 32 bp, Artificial Sequence
  Synthetic polynucleotide
cgacaggattttttttttttttttatacttaa

SEQ ID NO: 8527 - DNA, 32 bp, Artificial Sequence
  Synthetic polynucleotide
ttttttttaggggaaccgtagacttttttttt

SEQ ID NO: 8528 - DNA, 32 bp, Artificial Sequence
  Synthetic polynucleotide
agctctagtttttttttttttttttcacataa

SEQ ID NO: 8529 - DNA, 32 bp, Artificial Sequence
  Synthetic polynucleotide
ttttttttcggcgagtgttctaggtttttttt

SEQ ID NO: 8530 - DNA, 32 bp, Artificial Sequence
  Synthetic polynucleotide
aaaacactttttttttttttttttgagcgggg

SEQ ID NO: 8531 - DNA, 32 bp, Artificial Sequence
  Synthetic polynucleotide
ttttttttcccagcattccttcagtttttttt

SEQ ID NO: 8532 - DNA, 32 bp, Artificial Sequence
  Synthetic polynucleotide
atggtacatttttttttttttttttccgccta

SEQ ID NO: 8533 - DNA, 32 bp, Artificial Sequence
  Synthetic polynucleotide
ttttttttctttgatattctcccatttttttt

SEQ ID NO: 8534 - DNA, 32 bp, Artificial Sequence
  Synthetic polynucleotide
ctcatgatttttttttttttttttaatggata

SEQ ID NO: 8535 - DNA, 32 bp, Artificial Sequence
  Synthetic polynucleotide
ttttttttacaaaaaacttgcctatttttttt

SEQ ID NO: 8536 - DNA, 32 bp, Artificial Sequence
  Synthetic polynucleotide
gggcgtaatttttttttttttttttcgtgccc

SEQ ID NO: 8537 - DNA, 32 bp, Artificial Sequence
  Synthetic polynucleotide
ttttttttcattgtctaccacctatttttttt

SEQ ID NO: 8538 - DNA, 32 bp, Artificial Sequence
  Synthetic polynucleotide
tcatacagtttttttttttttttttgttctta

SEQ ID NO: 8539 - DNA, 32 bp, Artificial Sequence
  Synthetic polynucleotide
ttttttttacatagatcgtcgggctttttttt

SEQ ID NO: 8540 - DNA, 32 bp, Artificial Sequence
  Synthetic polynucleotide
tgctgttattttttttttttttttgaccttcg

SEQ ID NO: 8541 - DNA, 32 bp, Artificial Sequence
  Synthetic polynucleotide
ttttttttggccgaccaccgaccatttttttt

SEQ ID NO: 8542 - DNA, 32 bp, Artificial Sequence
  Synthetic polynucleotide
taaggtggttttttttttttttttaggcgcta

SEQ ID NO: 8543 - DNA, 32 bp, Artificial Sequence
  Synthetic polynucleotide
ttttttttactcgtaagcgatatctttttttt

SEQ ID NO: 8544 - DNA, 32 bp, Artificial Sequence
  Synthetic polynucleotide
tagggtattttttttttttttttttgaatgcg

SEQ ID NO: 8545 - DNA, 32 bp, Artificial Sequence
  Synthetic polynucleotide
ttttttttaacgacaaaaaatacctttttttt

SEQ ID NO: 8546 - DNA, 32 bp, Artificial Sequence
  Synthetic polynucleotide
taatacgattttttttttttttttttcgccgg

SEQ ID NO: 8547 - DNA, 32 bp, Artificial Sequence; identical to SEQ ID NO: 5633
  Synthetic polynucleotide

SEQ ID NO: 8548 - DNA, 32 bp, Artificial Sequence
  Synthetic polynucleotide
tccgtccgttttttttttttttttaacgcatc

SEQ ID NO: 8549 - DNA, 32 bp, Artificial Sequence
  Synthetic polynucleotide
ttttttttcggaggcgcattaggttttttttt

SEQ ID NO: 8550 - DNA, 32 bp, Artificial Sequence
  Synthetic polynucleotide
accattacttttttttttttttttctattata

SEQ ID NO: 8551 - DNA, 32 bp, Artificial Sequence
  Synthetic polynucleotide
tttttttttataaaatggcactgttttttttt

SEQ ID NO: 8552 - DNA, 32 bp, Artificial Sequence
  Synthetic polynucleotide
tatcgttcttttttttttttttttcacggcgc

SEQ ID NO: 8553 - DNA, 32 bp, Artificial Sequence
  Synthetic polynucleotide
tttttttttacaatgtgtctgacctttttttt

SEQ ID NO: 8554 - DNA, 32 bp, Artificial Sequence
  Synthetic polynucleotide
atatcatcttttttttttttttttcttcacat

SEQ ID NO: 8555 - DNA, 32 bp, Artificial Sequence
  Synthetic polynucleotide
ttttttttggattacccttcaatatttttttt

SEQ ID NO: 8556 - DNA, 32 bp, Artificial Sequence
  Synthetic polynucleotide
taatatggttttttttttttttttagttgtag

SEQ ID NO: 8557 - DNA, 32 bp, Artificial Sequence
  Synthetic polynucleotide
tttttttttggcaggtgccatccttttttttt

SEQ ID NO: 8558 - DNA, 32 bp, Artificial Sequence
  Synthetic polynucleotide
gcatcagcttttttttttttttttacccgctt

SEQ ID NO: 8559 - DNA, 32 bp, Artificial Sequence
  Synthetic polynucleotide
ttttttttgaagcaggatgtgtaatttttttt

SEQ ID NO: 8560 - DNA, 32 bp, Artificial Sequence
  Synthetic polynucleotide
tctcatgctttttttttttttttttggtgggc

SEQ ID NO: 8561 - DNA, 32 bp, Artificial Sequence
  Synthetic polynucleotide
tttttttttctgcgccagcgccactttttttt

SEQ ID NO: 8562 - DNA, 32 bp, Artificial Sequence
  Synthetic polynucleotide
ggacgatattttttttttttttttgtccccaa

SEQ ID NO: 8563 - DNA, 32 bp, Artificial Sequence
  Synthetic polynucleotide
ttttttttacctgtcattggagtgtttttttt

SEQ ID NO: 8564 - DNA, 32 bp, Artificial Sequence
  Synthetic polynucleotide
ttgtcgggttttttttttttttttatgaacaa

SEQ ID NO: 8565 - DNA, 32 bp, Artificial Sequence
  Synthetic polynucleotide
ttttttttctgctgccgccctttgtttttttt

SEQ ID NO: 8566 - DNA, 32 bp, Artificial Sequence
  Synthetic polynucleotide
cctgggtcttttttttttttttttgggttcac

SEQ ID NO: 8567 - DNA, 32 bp, Artificial Sequence
  Synthetic polynucleotide
ttttttttataacctaagtaatgttttttttt

SEQ ID NO: 8568 - DNA, 32 bp, Artificial Sequence
  Synthetic polynucleotide
gcccgcgcttttttttttttttttctagtgcc

SEQ ID NO: 8569 - DNA, 32 bp, Artificial Sequence
  Synthetic polynucleotide
ttttttttaagagtcaagcgtaaatttttttt

SEQ ID NO: 8570 - DNA, 32 bp, Artificial Sequence
  Synthetic polynucleotide
gtatgtgattttttttttttttttgtcttgac

SEQ ID NO: 8571 - DNA, 32 bp, Artificial Sequence
  Synthetic polynucleotide
tttttttttccagctgacggtatgtttttttt

SEQ ID NO: 8572 - DNA, 32 bp, Artificial Sequence
  Synthetic polynucleotide
gtattccattttttttttttttttgaaagaag

SEQ ID NO: 8573 - DNA, 32 bp, Artificial Sequence
  Synthetic polynucleotide
ttttttttctcgagtctacagcagtttttttt

SEQ ID NO: 8574 - DNA, 32 bp, Artificial Sequence
  Synthetic polynucleotide
cgaaggggttttttttttttttttagctacgc

SEQ ID NO: 8575 - DNA, 32 bp, Artificial Sequence
  Synthetic polynucleotide
tttttttttctttaaatgtcccgttttttttt

SEQ ID NO: 8576 - DNA, 32 bp, Artificial Sequence
  Synthetic polynucleotide
gtcccacgttttttttttttttttgttagggc

SEQ ID NO: 8577 - DNA, 32 bp, Artificial Sequence
  Synthetic polynucleotide
ttttttttcgtggaatccattcagtttttttt

SEQ ID NO: 8578 - DNA, 32 bp, Artificial Sequence
  Synthetic polynucleotide
tcgcatctttttttttttttttttttcacagg

SEQ ID NO: 8579 - DNA, 32 bp, Artificial Sequence
  Synthetic polynucleotide
ttttttttcgtacaaagcgttacttttttttt

SEQ ID NO: 8580 - DNA, 32 bp, Artificial Sequence
  Synthetic polynucleotide
cccttagcttttttttttttttttgacccgct

SEQ ID NO: 8581 - DNA, 32 bp, Artificial Sequence
  Synthetic polynucleotide
ttttttttatgcaaaactatgtcttttttttt

SEQ ID NO: 8582 - DNA, 32 bp, Artificial Sequence
  Synthetic polynucleotide
gcaggtaattttttttttttttttttctgagg

SEQ ID NO: 8583 - DNA, 32 bp, Artificial Sequence
  Synthetic polynucleotide
tttttttttttgggtctacggcactttttttt

SEQ ID NO: 8584 - DNA, 32 bp, Artificial Sequence
  Synthetic polynucleotide
aggagcagttttttttttttttttcgaggcct

SEQ ID NO: 8585 - DNA, 32 bp, Artificial Sequence
  Synthetic polynucleotide
ttttttttgaccctaagagtcccctttttttt

SEQ ID NO: 8586 - DNA, 32 bp, Artificial Sequence
  Synthetic polynucleotide
aatccgatttttttttttttttttgaagaata

SEQ ID NO: 8587 - DNA, 32 bp, Artificial Sequence
  Synthetic polynucleotide
tttttttttccgccggcaagtaagtttttttt

SEQ ID NO: 8588 - DNA, 32 bp, Artificial Sequence
  Synthetic polynucleotide
ggatattcttttttttttttttttcagggcgt

SEQ ID NO: 8589 - DNA, 32 bp, Artificial Sequence
  Synthetic polynucleotide
tttttttttcaaccggcgacgagttttttttt

SEQ ID NO: 8590 - DNA, 32 bp, Artificial Sequence
  Synthetic polynucleotide
aaaagcagttttttttttttttttaacggcat

SEQ ID NO: 8591 - DNA, 32 bp, Artificial Sequence
  Synthetic polynucleotide
tttttttttttttataactgctggtttttttt

SEQ ID NO: 8592 - DNA, 32 bp, Artificial Sequence
  Synthetic polynucleotide
cttccgacttttttttttttttttgtgggcgc

SEQ ID NO: 8593 - DNA, 32 bp, Artificial Sequence
  Synthetic polynucleotide
ttttttttggacgtttgagcaatatttttttt

SEQ ID NO: 8594 - DNA, 32 bp, Artificial Sequence
  Synthetic polynucleotide
cactgtgtttttttttttttttttgaaattga

SEQ ID NO: 8595 - DNA, 32 bp, Artificial Sequence
  Synthetic polynucleotide
ttttttttaagacgtagaatgagctttttttt

SEQ ID NO: 8596 - DNA, 32 bp, Artificial Sequence
  Synthetic polynucleotide
atcggctcttttttttttttttttgacgcacc

SEQ ID NO: 8597 - DNA, 32 bp, Artificial Sequence
  Synthetic polynucleotide
ttttttttacaacatgactacagttttttttt

SEQ ID NO: 8598 - DNA, 32 bp, Artificial Sequence
  Synthetic polynucleotide
tgtccaagtttttttttttttttttgaccggg

SEQ ID NO: 8599 - DNA, 32 bp, Artificial Sequence
  Synthetic polynucleotide
ttttttttaagcgcaacggcgccgtttttttt

SEQ ID NO: 8600 - DNA, 32 bp, Artificial Sequence
  Synthetic polynucleotide
ggtgcaaattttttttttttttttattgatca

SEQ ID NO: 8601 - DNA, 32 bp, Artificial Sequence; identical to SEQ ID NO: 5634
  Synthetic polynucleotide

SEQ ID NO: 8602 - DNA, 32 bp, Artificial Sequence
  Synthetic polynucleotide
atggttaattttttttttttttttcgatggca

SEQ ID NO: 8603 - DNA, 32 bp, Artificial Sequence
  Synthetic polynucleotide
ttttttttcggaccttccaccgggtttttttt

SEQ ID NO: 8604 - DNA, 32 bp, Artificial Sequence
  Synthetic polynucleotide
gcaatatttttttttttttttttttctgttcc

SEQ ID NO: 8605 - DNA, 32 bp, Artificial Sequence
  Synthetic polynucleotide
ttttttttggaatactcagccttctttttttt

SEQ ID NO: 8606 - DNA, 32 bp, Artificial Sequence
  Synthetic polynucleotide
attgagcattttttttttttttttaccgcggg

SEQ ID NO: 8607 - DNA, 32 bp, Artificial Sequence
  Synthetic polynucleotide
ttttttttgtacacatctctggcttttttttt

SEQ ID NO: 8608 - DNA, 32 bp, Artificial Sequence
  Synthetic polynucleotide
tctctatcttttttttttttttttttaccaag

SEQ ID NO: 8609 - DNA, 32 bp, Artificial Sequence
  Synthetic polynucleotide
ttttttttgggacagtcggaacattttttttt

SEQ ID NO: 8610 - DNA, 32 bp, Artificial Sequence
  Synthetic polynucleotide
ccactaacttttttttttttttttgcacgatg

SEQ ID NO: 8611 - DNA, 32 bp, Artificial Sequence
  Synthetic polynucleotide
ttttttttgggtgccaccgcaacctttttttt

SEQ ID NO: 8612 - DNA, 32 bp, Artificial Sequence
  Synthetic polynucleotide
tccgggattttttttttttttttttttacgtg

SEQ ID NO: 8613 - DNA, 32 bp, Artificial Sequence
  Synthetic polynucleotide
ttttttttatacaagattcagcagtttttttt

SEQ ID NO: 8614 - DNA, 32 bp, Artificial Sequence
  Synthetic polynucleotide
tttagggattttttttttttttttccttactc

SEQ ID NO: 8615 - DNA, 32 bp, Artificial Sequence
  Synthetic polynucleotide
ttttttttcacggacaggaacaactttttttt

SEQ ID NO: 8616 - DNA, 32 bp, Artificial Sequence
  Synthetic polynucleotide
agcaatatttttttttttttttttgggtgtca

SEQ ID NO: 8617 - DNA, 32 bp, Artificial Sequence
  Synthetic polynucleotide
ttttttttaagggcaatcgtattttttttttt

SEQ ID NO: 8618 - DNA, 32 bp, Artificial Sequence
  Synthetic polynucleotide
gtccaagtttttttttttttttttgatgcccg

SEQ ID NO: 8619 - DNA, 32 bp, Artificial Sequence
  Synthetic polynucleotide
ttttttttctcacttttctggcgctttttttt

SEQ ID NO: 8620 - DNA, 32 bp, Artificial Sequence
  Synthetic polynucleotide
tgtgtatgttttttttttttttttcggcttag

SEQ ID NO: 8621 - DNA, 32 bp, Artificial Sequence
  Synthetic polynucleotide
ttttttttcattgtggttcgccgctttttttt

SEQ ID NO: 8622 - DNA, 32 bp, Artificial Sequence
  Synthetic polynucleotide
ccgtcacgttttttttttttttttgtcgtttt

SEQ ID NO: 8623 - DNA, 32 bp, Artificial Sequence
  Synthetic polynucleotide
ttttttttaagattcaacaggacgtttttttt

SEQ ID NO: 8624 - DNA, 32 bp, Artificial Sequence
  Synthetic polynucleotide
ctcagtttttttttttttttttttatgttctc

SEQ ID NO: 8625 - DNA, 32 bp, Artificial Sequence
  Synthetic polynucleotide
ttttttttaggtcttaattttggctttttttt

SEQ ID NO: 8626 - DNA, 32 bp, Artificial Sequence
  Synthetic polynucleotide
acctcttcttttttttttttttttggaacggg

SEQ ID NO: 8627 - DNA, 32 bp, Artificial Sequence
  Synthetic polynucleotide
ttttttttcgtccttggcatccgctttttttt

SEQ ID NO: 8628 - DNA, 32 bp, Artificial Sequence
  Synthetic polynucleotide
aagcatcgtttttttttttttttttcgcatgg

SEQ ID NO: 8629 - DNA, 32 bp, Artificial Sequence
  Synthetic polynucleotide
tttttttttgtggcaatacaatattttttttt

SEQ ID NO: 8630 - DNA, 32 bp, Artificial Sequence
  Synthetic polynucleotide
ttaagatgttttttttttttttttagttatat

SEQ ID NO: 8631 - DNA, 32 bp, Artificial Sequence
  Synthetic polynucleotide
ttttttttaacggtcgtatccgcctttttttt

SEQ ID NO: 8632 - DNA, 32 bp, Artificial Sequence
  Synthetic polynucleotide
cctcatgttttttttttttttttttatctcgc

SEQ ID NO: 8633 - DNA, 32 bp, Artificial Sequence; identical to SEQ ID NO: 5635
  Synthetic polynucleotide

SEQ ID NO: 8634 - DNA, 32 bp, Artificial Sequence
  Synthetic polynucleotide
agagttctttttttttttttttttgcagccct

SEQ ID NO: 8635 - DNA, 32 bp, Artificial Sequence
  Synthetic polynucleotide
ttttttttggacatcacatctctgtttttttt

SEQ ID NO: 8636 - DNA, 32 bp, Artificial Sequence
  Synthetic polynucleotide
tcatcgtattttttttttttttttcctcgacg

SEQ ID NO: 8637 - DNA, 32 bp, Artificial Sequence
  Synthetic polynucleotide
ttttttttcaatggaggtgggcgctttttttt

SEQ ID NO: 8638 - DNA, 32 bp, Artificial Sequence
  Synthetic polynucleotide
tacgcgggttttttttttttttttaaaccgtt

SEQ ID NO: 8639 - DNA, 32 bp, Artificial Sequence
  Synthetic polynucleotide
ttttttttttaaacagttgaaggttttttttt

SEQ ID NO: 8640 - DNA, 32 bp, Artificial Sequence
  Synthetic polynucleotide
ttcaacttttttttttttttttttttgaacca

SEQ ID NO: 8641 - DNA, 32 bp, Artificial Sequence
  Synthetic polynucleotide
ttttttttttcccaggttattgagtttttttt

SEQ ID NO: 8642 - DNA, 32 bp, Artificial Sequence
  Synthetic polynucleotide
ttccttgattttttttttttttttacctatct

SEQ ID NO: 8643 - DNA, 32 bp, Artificial Sequence
  Synthetic polynucleotide
ttttttttctacagcaccgtgatgtttttttt

SEQ ID NO: 8644 - DNA, 32 bp, Artificial Sequence
  Synthetic polynucleotide
atcacgctttttttttttttttttagacttcg

SEQ ID NO: 8645 - DNA, 32 bp, Artificial Sequence
  Synthetic polynucleotide
ttttttttacgcctgcttccgtggtttttttt

SEQ ID NO: 8646 - DNA, 32 bp, Artificial Sequence
  Synthetic polynucleotide
tgcgttcgttttttttttttttttccccgcaa

SEQ ID NO: 8647 - DNA, 32 bp, Artificial Sequence
  Synthetic polynucleotide
ttttttttctgagggggaggggattttttttt

SEQ ID NO: 8648 - DNA, 32 bp, Artificial Sequence
  Synthetic polynucleotide
ccgcatcgttttttttttttttttagcatacc

SEQ ID NO: 8649 - DNA, 32 bp, Artificial Sequence
  Synthetic polynucleotide
ttttttttaccctcgcgggtgatctttttttt

SEQ ID NO: 8650 - DNA, 32 bp, Artificial Sequence
  Synthetic polynucleotide
cagcacaattttttttttttttttggccgtta

SEQ ID NO: 8651 - DNA, 32 bp, Artificial Sequence
  Synthetic polynucleotide
ttttttttgtgctgtgttctatcgtttttttt

SEQ ID NO: 8652 - DNA, 32 bp, Artificial Sequence
  Synthetic polynucleotide
gtcgtaatttttttttttttttttatctcctt

SEQ ID NO: 8653 - DNA, 32 bp, Artificial Sequence
  Synthetic polynucleotide
ttttttttaatgcaaaaccatgtttttttttt

SEQ ID NO: 8654 - DNA, 32 bp, Artificial Sequence
  Synthetic polynucleotide
cgcaacaattttttttttttttttgaaattgt

SEQ ID NO: 8655 - DNA, 32 bp, Artificial Sequence
  Synthetic polynucleotide
ttttttttcacgaggcacacggcgtttttttt

SEQ ID NO: 8656 - DNA, 32 bp, Artificial Sequence
  Synthetic polynucleotide
gctgccgatttttttttttttttttcagcgat

SEQ ID NO: 8657 - DNA, 32 bp, Artificial Sequence
  Synthetic polynucleotide
ttttttttcctagcaataagacaatttttttt

SEQ ID NO: 8658 - DNA, 32 bp, Artificial Sequence
  Synthetic polynucleotide
cgcatctattttttttttttttttgtagaaca

SEQ ID NO: 8659 - DNA, 32 bp, Artificial Sequence
  Synthetic polynucleotide
ttttttttggtgtagtggattcattttttttt

SEQ ID NO: 8660 - DNA, 32 bp, Artificial Sequence
  Synthetic polynucleotide
ttgtgttgttttttttttttttttttaactac

SEQ ID NO: 8661 - DNA, 32 bp, Artificial Sequence
  Synthetic polynucleotide
ttttttttttacctaataccatgatttttttt

SEQ ID NO: 8662 - DNA, 32 bp, Artificial Sequence
  Synthetic polynucleotide
cgatgttattttttttttttttttggagcagg

SEQ ID NO: 8663 - DNA, 32 bp, Artificial Sequence
  Synthetic polynucleotide
ttttttttaatacatttatgaatctttttttt

SEQ ID NO: 8664 - DNA, 32 bp, Artificial Sequence
  Synthetic polynucleotide
gattgactttttttttttttttttcagacacg

SEQ ID NO: 8665 - DNA, 32 bp, Artificial Sequence
  Synthetic polynucleotide
tttttttttccggggagtagtctgtttttttt

SEQ ID NO: 8666 - DNA, 32 bp, Artificial Sequence
  Synthetic polynucleotide
aggtacactttttttttttttttttagggtga

SEQ ID NO: 8667 - DNA, 32 bp, Artificial Sequence
  Synthetic polynucleotide
ttttttttgcaagctcgtcaagtgtttttttt

SEQ ID NO: 8668 - DNA, 32 bp, Artificial Sequence
  Synthetic polynucleotide
tatacccgttttttttttttttttgtatagcc

SEQ ID NO: 8669 - DNA, 32 bp, Artificial Sequence
  Synthetic polynucleotide
tttttttttacgctccaaatactgtttttttt

SEQ ID NO: 8670 - DNA, 32 bp, Artificial Sequence
  Synthetic polynucleotide
cgcagcacttttttttttttttttcccacggt

SEQ ID NO: 8671 - DNA, 32 bp, Artificial Sequence
  Synthetic polynucleotide
ttttttttctccataaaggcgtcttttttttt

SEQ ID NO: 8672 - DNA, 32 bp, Artificial Sequence
  Synthetic polynucleotide
attaggcattttttttttttttttcaggaagt

SEQ ID NO: 8673 - DNA, 32 bp, Artificial Sequence
  Synthetic polynucleotide
ttttttttctcgacaataccctcctttttttt

SEQ ID NO: 8674 - DNA, 32 bp, Artificial Sequence
  Synthetic polynucleotide
gttttgtgttttttttttttttttctctgcgg

SEQ ID NO: 8675 - DNA, 32 bp, Artificial Sequence
  Synthetic polynucleotide
ttttttttcattggcactataagatttttttt

SEQ ID NO: 8676 - DNA, 32 bp, Artificial Sequence
  Synthetic polynucleotide
cgcgaccattttttttttttttttctactcca

SEQ ID NO: 8677 - DNA, 32 bp, Artificial Sequence
  Synthetic polynucleotide
ttttttttttgaccgatccagagctttttttt

SEQ ID NO: 8678 - DNA, 32 bp, Artificial Sequence
  Synthetic polynucleotide
accacctgtttttttttttttttttaagaaaa

SEQ ID NO: 8679 - DNA, 32 bp, Artificial Sequence
  Synthetic polynucleotide
tttttttttatcagaggtcgtaactttttttt

SEQ ID NO: 8680 - DNA, 32 bp, Artificial Sequence
  Synthetic polynucleotide
cctcgtgatttttttttttttttttcggtcgc

SEQ ID NO: 8681 - DNA, 32 bp, Artificial Sequence
  Synthetic polynucleotide
ttttttttttggctcaaaacgtcttttttttt

SEQ ID NO: 8682 - DNA, 32 bp, Artificial Sequence
  Synthetic polynucleotide
ggtatgcattttttttttttttttagtatttc

SEQ ID NO: 8683 - DNA, 32 bp, Artificial Sequence
  Synthetic polynucleotide
ttttttttgcgtgaggtatgggcctttttttt

SEQ ID NO: 8684 - DNA, 32 bp, Artificial Sequence
  Synthetic polynucleotide
tagactcatttttttttttttttttcatcccc

SEQ ID NO: 8685 - DNA, 32 bp, Artificial Sequence
  Synthetic polynucleotide
ttttttttcatgtatgtactcatctttttttt

SEQ ID NO: 8686 - DNA, 32 bp, Artificial Sequence
  Synthetic polynucleotide
tgacgcagttttttttttttttttagcaccta

SEQ ID NO: 8687 - DNA, 32 bp, Artificial Sequence
  Synthetic polynucleotide
ttttttttccatccctcgagggtttttttttt

SEQ ID NO: 8688 - DNA, 32 bp, Artificial Sequence
  Synthetic polynucleotide
taacctggtttttttttttttttttgtttcac

SEQ ID NO: 8689 - DNA, 32 bp, Artificial Sequence
  Synthetic polynucleotide
tttttttttccggtttgggcactctttttttt

SEQ ID NO: 8690 - DNA, 32 bp, Artificial Sequence
  Synthetic polynucleotide
gtatgattttttttttttttttttgtataacc

SEQ ID NO: 8691 - DNA, 32 bp, Artificial Sequence
  Synthetic polynucleotide
ttttttttgcggccatgttatttctttttttt

SEQ ID NO: 8692 - DNA, 32 bp, Artificial Sequence
  Synthetic polynucleotide
acccgagctttttttttttttttttatttcga

SEQ ID NO: 8693 - DNA, 32 bp, Artificial Sequence
  Synthetic polynucleotide
ttttttttcgctcagccggaacagtttttttt

SEQ ID NO: 8694 - DNA, 32 bp, Artificial Sequence
  Synthetic polynucleotide
cactgagtttttttttttttttttccaaggca

SEQ ID NO: 8695 - DNA, 32 bp, Artificial Sequence
  Synthetic polynucleotide
ttttttttacagctaagaacttgatttttttt

SEQ ID NO: 8696 - DNA, 32 bp, Artificial Sequence
  Synthetic polynucleotide
acaggcggttttttttttttttttatcatggt

SEQ ID NO: 8697 - DNA, 32 bp, Artificial Sequence
  Synthetic polynucleotide
ttttttttttccagcttgacgatctttttttt

SEQ ID NO: 8698 - DNA, 32 bp, Artificial Sequence
  Synthetic polynucleotide
tcagaaacttttttttttttttttcgcagggt

SEQ ID NO: 8699 - DNA, 32 bp, Artificial Sequence
  Synthetic polynucleotide
tttttttttgcgatcattagtgagtttttttt

SEQ ID NO: 8700 - DNA, 32 bp, Artificial Sequence
  Synthetic polynucleotide
gagggaacttttttttttttttttgtttcctt

SEQ ID NO: 8701 - DNA, 32 bp, Artificial Sequence
  Synthetic polynucleotide
ttttttttagttttggcttacatctttttttt

SEQ ID NO: 8702 - DNA, 32 bp, Artificial Sequence
  Synthetic polynucleotide
ccaggtcattttttttttttttttgcccccta

SEQ ID NO: 8703 - DNA, 32 bp, Artificial Sequence
  Synthetic polynucleotide
tttttttttcagtcgtcgagtcgttttttttt

SEQ ID NO: 8704 - DNA, 32 bp, Artificial Sequence
  Synthetic polynucleotide
agatgttcttttttttttttttttaacctcgt

SEQ ID NO: 8705 - DNA, 32 bp, Artificial Sequence
  Synthetic polynucleotide
ttttttttttaatttgagtttccttttttttt

SEQ ID NO: 8706 - DNA, 32 bp, Artificial Sequence
  Synthetic polynucleotide
ataatagtttttttttttttttttcagaagtg

SEQ ID NO: 8707 - DNA, 32 bp, Artificial Sequence
  Synthetic polynucleotide
ttttttttccaaggagggaatgcatttttttt

SEQ ID NO: 8708 - DNA, 32 bp, Artificial Sequence
  Synthetic polynucleotide
cccagtgattttttttttttttttacaccggc

SEQ ID NO: 8709 - DNA, 32 bp, Artificial Sequence
  Synthetic polynucleotide
ttttttttgtatagcgctcgacggtttttttt

SEQ ID NO: 8710 - DNA, 32 bp, Artificial Sequence
  Synthetic polynucleotide
ctaatatattttttttttttttttaggatatg

SEQ ID NO: 8711 - DNA, 32 bp, Artificial Sequence
  Synthetic polynucleotide
tttttttttgggtaagatgtggtttttttttt

SEQ ID NO: 8712 - DNA, 32 bp, Artificial Sequence
  Synthetic polynucleotide
tctttctcttttttttttttttttccattacg

SEQ ID NO: 8713 - DNA, 32 bp, Artificial Sequence
  Synthetic polynucleotide
ttttttttccaccgcaatcgactatttttttt

SEQ ID NO: 8714 - DNA, 32 bp, Artificial Sequence
  Synthetic polynucleotide
cacgcgagttttttttttttttttggaaggac

SEQ ID NO: 8715 - DNA, 32 bp, Artificial Sequence
  Synthetic polynucleotide
ttttttttctatgtagatctggtctttttttt

SEQ ID NO: 8716 - DNA, 32 bp, Artificial Sequence
  Synthetic polynucleotide
gatagctgttttttttttttttttattgaaag

SEQ ID NO: 8717 - DNA, 32 bp, Artificial Sequence
  Synthetic polynucleotide
ttttttttgaatatggaaagactgtttttttt

SEQ ID NO: 8718 - DNA, 32 bp, Artificial Sequence
  Synthetic polynucleotide
gacagggatttttttttttttttttgcgagat

SEQ ID NO: 8719 - DNA, 32 bp, Artificial Sequence
  Synthetic polynucleotide
ttttttttgctcgacaagctctgttttttttt

SEQ ID NO: 8720 - DNA, 32 bp, Artificial Sequence
  Synthetic polynucleotide
ggtcagaatttttttttttttttttcctatga

SEQ ID NO: 8721 - DNA, 32 bp, Artificial Sequence
  Synthetic polynucleotide
tttttttttgagctttgagtcggctttttttt

SEQ ID NO: 8722 - DNA, 32 bp, Artificial Sequence
  Synthetic polynucleotide
cccccaagttttttttttttttttctgacaga

SEQ ID NO: 8723 - DNA, 32 bp, Artificial Sequence
  Synthetic polynucleotide
ttttttttacgcttagcgcccacttttttttt

SEQ ID NO: 8724 - DNA, 32 bp, Artificial Sequence
  Synthetic polynucleotide
tcatccggttttttttttttttttctatgaac

SEQ ID NO: 8725 - DNA, 32 bp, Artificial Sequence
  Synthetic polynucleotide
ttttttttttcataacacactgactttttttt

SEQ ID NO: 8726 - DNA, 32 bp, Artificial Sequence
  Synthetic polynucleotide
ggcgcatattttttttttttttttaccctttt

SEQ ID NO: 8727 - DNA, 32 bp, Artificial Sequence
  Synthetic polynucleotide
ttttttttggatatcgcagcccattttttttt

SEQ ID NO: 8728 - DNA, 32 bp, Artificial Sequence
  Synthetic polynucleotide
cctatctttttttttttttttttttacccaca

SEQ ID NO: 8729 - DNA, 32 bp, Artificial Sequence
  Synthetic polynucleotide
ttttttttgctgtgaccagagccgtttttttt

SEQ ID NO: 8730 - DNA, 32 bp, Artificial Sequence
  Synthetic polynucleotide
agctgttcttttttttttttttttaggtcagg

SEQ ID NO: 8731 - DNA, 32 bp, Artificial Sequence
  Synthetic polynucleotide
tttttttttccccgtctccaaacctttttttt

SEQ ID NO: 8732 - DNA, 32 bp, Artificial Sequence
  Synthetic polynucleotide
ctaacgatttttttttttttttttaaattgtg

SEQ ID NO: 8733 - DNA, 32 bp, Artificial Sequence
  Synthetic polynucleotide
tttttttttcgagaaagcaccgaatttttttt

SEQ ID NO: 8734 - DNA, 32 bp, Artificial Sequence
  Synthetic polynucleotide
agattgtattttttttttttttttaaaagccc

SEQ ID NO: 8735 - DNA, 32 bp, Artificial Sequence
  Synthetic polynucleotide
ttttttttttacttcgtgcccatgtttttttt

SEQ ID NO: 8736 - DNA, 32 bp, Artificial Sequence
  Synthetic polynucleotide
atcagttattttttttttttttttgtgacacg

SEQ ID NO: 8737 - DNA, 32 bp, Artificial Sequence
  Synthetic polynucleotide
ttttttttaggagaaaaacagcattttttttt

SEQ ID NO: 8738 - DNA, 32 bp, Artificial Sequence
  Synthetic polynucleotide
gtccaacattttttttttttttttggcttcat

SEQ ID NO: 8739 - DNA, 32 bp, Artificial Sequence
  Synthetic polynucleotide
tttttttttgataatctcccacgttttttttt

SEQ ID NO: 8740 - DNA, 32 bp, Artificial Sequence
  Synthetic polynucleotide
aggtggccttttttttttttttttacaacata

SEQ ID NO: 8741 - DNA, 32 bp, Artificial Sequence
  Synthetic polynucleotide
ttttttttcccgagccagttcgtatttttttt

SEQ ID NO: 8742 - DNA, 32 bp, Artificial Sequence
  Synthetic polynucleotide
ctaccgcttttttttttttttttttatgctct

SEQ ID NO: 8743 - DNA, 32 bp, Artificial Sequence
  Synthetic polynucleotide
ttttttttgtgggaggtaattagttttttttt

SEQ ID NO: 8744 - DNA, 32 bp, Artificial Sequence
  Synthetic polynucleotide
cttgacgattttttttttttttttacggccac

SEQ ID NO: 8745 - DNA, 32 bp, Artificial Sequence
  Synthetic polynucleotide
ttttttttaaagcagggatacttttttttttt

SEQ ID NO: 8746 - DNA, 32 bp, Artificial Sequence
  Synthetic polynucleotide
gaccatagttttttttttttttttgaaaaggc

SEQ ID NO: 8747 - DNA, 32 bp, Artificial Sequence
  Synthetic polynucleotide
ttttttttaccataccaacggcgatttttttt

SEQ ID NO: 8748 - DNA, 32 bp, Artificial Sequence
  Synthetic polynucleotide
aatgcacattttttttttttttttataaaagc

SEQ ID NO: 8749 - DNA, 32 bp, Artificial Sequence
  Synthetic polynucleotide
tttttttttcacgtggcctctccctttttttt

SEQ ID NO: 8750 - DNA, 32 bp, Artificial Sequence
  Synthetic polynucleotide
cgtgcacatttttttttttttttttgccgagg

SEQ ID NO: 8751 - DNA, 32 bp, Artificial Sequence
  Synthetic polynucleotide
ttttttttatccctgaacggggtttttttttt

SEQ ID NO: 8752 - DNA, 32 bp, Artificial Sequence
  Synthetic polynucleotide
agtacgacttttttttttttttttggggcata

SEQ ID NO: 8753 - DNA, 32 bp, Artificial Sequence
  Synthetic polynucleotide
ttttttttttgctttagaggcggctttttttt

SEQ ID NO: 8754 - DNA, 32 bp, Artificial Sequence
  Synthetic polynucleotide
agtatagtttttttttttttttttatcgggtt

SEQ ID NO: 8755 - DNA, 32 bp, Artificial Sequence
  Synthetic polynucleotide
ttttttttgcaacctaggtaggtttttttttt

SEQ ID NO: 8756 - DNA, 32 bp, Artificial Sequence
  Synthetic polynucleotide
cacttgagttttttttttttttttccgccgca

SEQ ID NO: 8757 - DNA, 32 bp, Artificial Sequence
  Synthetic polynucleotide
ttttttttactgttagggtacacgtttttttt

SEQ ID NO: 8758 - DNA, 32 bp, Artificial Sequence
  Synthetic polynucleotide
caggctacttttttttttttttttgcctgttt

SEQ ID NO: 8759 - DNA, 32 bp, Artificial Sequence
  Synthetic polynucleotide
ttttttttgcgcgccttcaaggcctttttttt

SEQ ID NO: 8760 - DNA, 32 bp, Artificial Sequence
  Synthetic polynucleotide
atgtagcattttttttttttttttcgacatcc

SEQ ID NO: 8761 - DNA, 32 bp, Artificial Sequence
  Synthetic polynucleotide
ttttttttagaaactgtaggttaatttttttt

SEQ ID NO: 8762 - DNA, 32 bp, Artificial Sequence
  Synthetic polynucleotide
tatggtttttttttttttttttttatcagcta

SEQ ID NO: 8763 - DNA, 32 bp, Artificial Sequence
  Synthetic polynucleotide
ttttttttggagcacttcgcaacgtttttttt

SEQ ID NO: 8764 - DNA, 32 bp, Artificial Sequence
  Synthetic polynucleotide
cgaatcaattttttttttttttttaggacgat

SEQ ID NO: 8765 - DNA, 32 bp, Artificial Sequence
  Synthetic polynucleotide
tttttttttatgtgatgtcgcatatttttttt

SEQ ID NO: 8766 - DNA, 32 bp, Artificial Sequence
  Synthetic polynucleotide
actgtacgtttttttttttttttttatcccaa

SEQ ID NO: 8767 - DNA, 32 bp, Artificial Sequence
  Synthetic polynucleotide
ttttttttggttggttcggcatgctttttttt

SEQ ID NO: 8768 - DNA, 32 bp, Artificial Sequence
  Synthetic polynucleotide
atatcaagttttttttttttttttggtctaaa

SEQ ID NO: 8769 - DNA, 32 bp, Artificial Sequence
  Synthetic polynucleotide
ttttttttgtccctcagctatgcttttttttt

SEQ ID NO: 8770 - DNA, 32 bp, Artificial Sequence
  Synthetic polynucleotide
catatattttttttttttttttttaggtagag

SEQ ID NO: 8771 - DNA, 32 bp, Artificial Sequence
  Synthetic polynucleotide
ttttttttgaggatgtacttgggatttttttt

SEQ ID NO: 8772 - DNA, 32 bp, Artificial Sequence
  Synthetic polynucleotide
ctaatgaattttttttttttttttttaggatc

SEQ ID NO: 8773 - DNA, 32 bp, Artificial Sequence
  Synthetic polynucleotide
ttttttttttccgccctggagttatttttttt

SEQ ID NO: 8774 - DNA, 32 bp, Artificial Sequence
  Synthetic polynucleotide
cgaccatgttttttttttttttttgatgtccg

SEQ ID NO: 8775 - DNA, 32 bp, Artificial Sequence
  Synthetic polynucleotide
ttttttttcagtagaaagcctacgtttttttt

SEQ ID NO: 8776 - DNA, 32 bp, Artificial Sequence
  Synthetic polynucleotide
ctcggccctttttttttttttttttccgtgca

SEQ ID NO: 8777 - DNA, 32 bp, Artificial Sequence
  Synthetic polynucleotide
ttttttttgcccagcggtttgaactttttttt

SEQ ID NO: 8778 - DNA, 32 bp, Artificial Sequence
  Synthetic polynucleotide
aataaggattttttttttttttttctgtttac

SEQ ID NO: 8779 - DNA, 32 bp, Artificial Sequence
  Synthetic polynucleotide
tttttttttaagccacagagtatatttttttt

SEQ ID NO: 8780 - DNA, 32 bp, Artificial Sequence
  Synthetic polynucleotide
tactaaaattttttttttttttttgatggccg

SEQ ID NO: 8781 - DNA, 32 bp, Artificial Sequence
  Synthetic polynucleotide
tttttttttgggtgttccaagtcatttttttt

SEQ ID NO: 8782 - DNA, 32 bp, Artificial Sequence
  Synthetic polynucleotide
ggaggcggttttttttttttttttgcccctcg

SEQ ID NO: 8783 - DNA, 32 bp, Artificial Sequence
  Synthetic polynucleotide
tttttttttgactaccgattgccgtttttttt

SEQ ID NO: 8784 - DNA, 32 bp, Artificial Sequence
  Synthetic polynucleotide
tagtttgatttttttttttttttttaaatggt

SEQ ID NO: 8785 - DNA, 32 bp, Artificial Sequence
  Synthetic polynucleotide
ttttttttgctgtattgtcgctggtttttttt

SEQ ID NO: 8786 - DNA, 32 bp, Artificial Sequence
  Synthetic polynucleotide
tttttgtcttttttttttttttttctaatcac

SEQ ID NO: 8787 - DNA, 32 bp, Artificial Sequence
  Synthetic polynucleotide
ttttttttgctgttcaacactaattttttttt

SEQ ID NO: 8788 - DNA, 32 bp, Artificial Sequence
  Synthetic polynucleotide
tagtccacttttttttttttttttccgggtat

SEQ ID NO: 8789 - DNA, 32 bp, Artificial Sequence
  Synthetic polynucleotide
ttttttttgcgctttccgtcttaatttttttt

SEQ ID NO: 8790 - DNA, 32 bp, Artificial Sequence
  Synthetic polynucleotide
ccgcacgtttttttttttttttttacgacttt

SEQ ID NO: 8791 - DNA, 32 bp, Artificial Sequence
  Synthetic polynucleotide
ttttttttaggagaagcacgacgatttttttt

SEQ ID NO: 8792 - DNA, 32 bp, Artificial Sequence
  Synthetic polynucleotide
cctactctttttttttttttttttcgggaatt

SEQ ID NO: 8793 - DNA, 32 bp, Artificial Sequence
  Synthetic polynucleotide
ttttttttgcactgccttccgcgttttttttt

SEQ ID NO: 8794 - DNA, 32 bp, Artificial Sequence
  Synthetic polynucleotide
ggcgatacttttttttttttttttgggtatag

SEQ ID NO: 8795 - DNA, 32 bp, Artificial Sequence
  Synthetic polynucleotide
ttttttttagtggagctgtcgtattttttttt

SEQ ID NO: 8796 - DNA, 32 bp, Artificial Sequence
  Synthetic polynucleotide
cagaaactttttttttttttttttaatgggta

SEQ ID NO: 8797 - DNA, 32 bp, Artificial Sequence
  Synthetic polynucleotide
ttttttttaggtctacgtgtcaagtttttttt

SEQ ID NO: 8798 - DNA, 32 bp, Artificial Sequence
  Synthetic polynucleotide
gaggtagcttttttttttttttttggaagttc

SEQ ID NO: 8799 - DNA, 32 bp, Artificial Sequence
  Synthetic polynucleotide
ttttttttgcgtatcgtcctcggttttttttt

SEQ ID NO: 8800 - DNA, 32 bp, Artificial Sequence
  Synthetic polynucleotide
actctcgtttttttttttttttttagggtgta

SEQ ID NO: 8801 - DNA, 32 bp, Artificial Sequence
  Synthetic polynucleotide
ttttttttatgccagctcatacgatttttttt

SEQ ID NO: 8802 - DNA, 32 bp, Artificial Sequence
  Synthetic polynucleotide
cgagatgtttttttttttttttttcaagaact

SEQ ID NO: 8803 - DNA, 32 bp, Artificial Sequence
  Synthetic polynucleotide
tttttttttctcataaaaaccgtttttttttt

SEQ ID NO: 8804 - DNA, 32 bp, Artificial Sequence
  Synthetic polynucleotide
cgtcgtctttttttttttttttttatggtttc

SEQ ID NO: 8805 - DNA, 32 bp, Artificial Sequence
  Synthetic polynucleotide
ttttttttaggagatctaactaagtttttttt

SEQ ID NO: 8806 - DNA, 32 bp, Artificial Sequence
  Synthetic polynucleotide
tggatatctttttttttttttttttggggcac

SEQ ID NO: 8807 - DNA, 32 bp, Artificial Sequence
  Synthetic polynucleotide
ttttttttatgtaccgaacagtgatttttttt

SEQ ID NO: 8808 - DNA, 32 bp, Artificial Sequence
  Synthetic polynucleotide
tcaagctgttttttttttttttttgctattcg

SEQ ID NO: 8809 - DNA, 32 bp, Artificial Sequence
  Synthetic polynucleotide
ttttttttgtcttgcgggtacacctttttttt

SEQ ID NO: 8810 - DNA, 32 bp, Artificial Sequence
  Synthetic polynucleotide
ccccaagttttttttttttttttttcacttgc

SEQ ID NO: 8811 - DNA, 32 bp, Artificial Sequence
  Synthetic polynucleotide
ttttttttgctacatggcagtccgtttttttt

SEQ ID NO: 8812 - DNA, 32 bp, Artificial Sequence
  Synthetic polynucleotide
tcgtacagttttttttttttttttatgttggg

SEQ ID NO: 8813 - DNA, 32 bp, Artificial Sequence
  Synthetic polynucleotide
ttttttttggactcatcctacaattttttttt

SEQ ID NO: 8814 - DNA, 32 bp, Artificial Sequence
  Synthetic polynucleotide
tatttgacttttttttttttttttagctttat

SEQ ID NO: 8815 - DNA, 32 bp, Artificial Sequence
  Synthetic polynucleotide
ttttttttagcacgcatttcaacttttttttt

SEQ ID NO: 8816 - DNA, 32 bp, Artificial Sequence
  Synthetic polynucleotide
tgtgggcttttttttttttttttttcttgcca

SEQ ID NO: 8817 - DNA, 32 bp, Artificial Sequence
  Synthetic polynucleotide
tttttttttgtcaagtgtgcagcttttttttt

SEQ ID NO: 8818 - DNA, 32 bp, Artificial Sequence
  Synthetic polynucleotide
ctaggaccttttttttttttttttatccgaat

SEQ ID NO: 8819 - DNA, 32 bp, Artificial Sequence
  Synthetic polynucleotide
tttttttttaaccctttaagcgcgtttttttt

SEQ ID NO: 8820 - DNA, 32 bp, Artificial Sequence
  Synthetic polynucleotide
tacgctatttttttttttttttttcacccgtt

SEQ ID NO: 8821 - DNA, 32 bp, Artificial Sequence
  Synthetic polynucleotide
ttttttttgtccggtcgtgggtaatttttttt

SEQ ID NO: 8822 - DNA, 32 bp, Artificial Sequence
  Synthetic polynucleotide
gtgggagattttttttttttttttgttatgga

SEQ ID NO: 8823 - DNA, 32 bp, Artificial Sequence
  Synthetic polynucleotide
ttttttttttggacgggcctggcctttttttt

SEQ ID NO: 8824 - DNA, 32 bp, Artificial Sequence
  Synthetic polynucleotide
agaaccggttttttttttttttttctacttca

SEQ ID NO: 8825 - DNA, 32 bp, Artificial Sequence
  Synthetic polynucleotide
ttttttttactctagccggtgagatttttttt

SEQ ID NO: 8826 - DNA, 32 bp, Artificial Sequence
  Synthetic polynucleotide
ccatgaaattttttttttttttttttccccag

SEQ ID NO: 8827 - DNA, 32 bp, Artificial Sequence
  Synthetic polynucleotide
tttttttttcgcgtcgccacaaagtttttttt

SEQ ID NO: 8828 - DNA, 32 bp, Artificial Sequence
  Synthetic polynucleotide
tacttgaattttttttttttttttggtgtcag

SEQ ID NO: 8829 - DNA, 32 bp, Artificial Sequence
  Synthetic polynucleotide
tttttttttcaccgaacgtacgcatttttttt

SEQ ID NO: 8830 - DNA, 32 bp, Artificial Sequence
  Synthetic polynucleotide
gcgccagatttttttttttttttttacgattt

SEQ ID NO: 8831 - DNA, 32 bp, Artificial Sequence
  Synthetic polynucleotide
ttttttttgtcctcacctctccgctttttttt

SEQ ID NO: 8832 - DNA, 32 bp, Artificial Sequence
  Synthetic polynucleotide
cggggaggttttttttttttttttcatattgt

SEQ ID NO: 8833 - DNA, 32 bp, Artificial Sequence
  Synthetic polynucleotide
ttttttttttgtaatgacgactcttttttttt

SEQ ID NO: 8834 - DNA, 32 bp, Artificial Sequence
  Synthetic polynucleotide
agcaggtcttttttttttttttttcatctgat

SEQ ID NO: 8835 - DNA, 32 bp, Artificial Sequence
  Synthetic polynucleotide
ttttttttgttaatgcgtgcatcttttttttt

SEQ ID NO: 8836 - DNA, 32 bp, Artificial Sequence
  Synthetic polynucleotide
aattcatcttttttttttttttttacatggtc

SEQ ID NO: 8837 - DNA, 32 bp, Artificial Sequence
  Synthetic polynucleotide
ttttttttccgaacgaggaacttgtttttttt

SEQ ID NO: 8838 - DNA, 32 bp, Artificial Sequence
  Synthetic polynucleotide
tgcttatcttttttttttttttttatgtcatg

SEQ ID NO: 8839 - DNA, 32 bp, Artificial Sequence
  Synthetic polynucleotide
ttttttttggtccttcaattagaatttttttt

SEQ ID NO: 8840 - DNA, 32 bp, Artificial Sequence
  Synthetic polynucleotide
aaagcttcttttttttttttttttgtcgaatt

SEQ ID NO: 8841 - DNA, 32 bp, Artificial Sequence
  Synthetic polynucleotide
ttttttttggctagaatgctggtgtttttttt

SEQ ID NO: 8842 - DNA, 32 bp, Artificial Sequence
  Synthetic polynucleotide
attaatacttttttttttttttttaaagatac

SEQ ID NO: 8843 - DNA, 32 bp, Artificial Sequence
  Synthetic polynucleotide
ttttttttgacttgattgttttcgtttttttt

SEQ ID NO: 8844 - DNA, 32 bp, Artificial Sequence
  Synthetic polynucleotide
cgtcacttttttttttttttttttctaggtgg

SEQ ID NO: 8845 - DNA, 32 bp, Artificial Sequence
  Synthetic polynucleotide
ttttttttgctgaggactcgttcgtttttttt

SEQ ID NO: 8846 - DNA, 32 bp, Artificial Sequence
  Synthetic polynucleotide
gcttctcgttttttttttttttttggtgctac

SEQ ID NO: 8847 - DNA, 32 bp, Artificial Sequence
  Synthetic polynucleotide
ttttttttatctataccgggtgtctttttttt

SEQ ID NO: 8848 - DNA, 32 bp, Artificial Sequence
  Synthetic polynucleotide
gccttgtcttttttttttttttttcctcaagc

SEQ ID NO: 8849 - DNA, 32 bp, Artificial Sequence
  Synthetic polynucleotide
ttttttttctgaagcggcgttaaatttttttt

SEQ ID NO: 8850 - DNA, 32 bp, Artificial Sequence
  Synthetic polynucleotide
gaggagcgttttttttttttttttctgcccag

SEQ ID NO: 8851 - DNA, 32 bp, Artificial Sequence
  Synthetic polynucleotide
tttttttttgacatcgtctgatggtttttttt

SEQ ID NO: 8852 - DNA, 32 bp, Artificial Sequence
  Synthetic polynucleotide
acccgagattttttttttttttttatctcagc

SEQ ID NO: 8853 - DNA, 32 bp, Artificial Sequence
  Synthetic polynucleotide
ttttttttcccgctcgccacatgatttttttt

SEQ ID NO: 8854 - DNA, 32 bp, Artificial Sequence
  Synthetic polynucleotide
cccatggattttttttttttttttaccgctct

SEQ ID NO: 8855 - DNA, 32 bp, Artificial Sequence
  Synthetic polynucleotide
tttttttttggtgaatactcgctatttttttt

SEQ ID NO: 8856 - DNA, 32 bp, Artificial Sequence
  Synthetic polynucleotide
gcctgtgattttttttttttttttgtcaactt

SEQ ID NO: 8857 - DNA, 32 bp, Artificial Sequence
  Synthetic polynucleotide
ttttttttcgtagttcgtaaacgatttttttt

SEQ ID NO: 8858 - DNA, 32 bp, Artificial Sequence
  Synthetic polynucleotide
accagttctttttttttttttttttaggtttc

SEQ ID NO: 8859 - DNA, 32 bp, Artificial Sequence
  Synthetic polynucleotide
ttttttttcacaaggggattgggttttttttt

SEQ ID NO: 8860 - DNA, 32 bp, Artificial Sequence
  Synthetic polynucleotide
tcacagtgttttttttttttttttatgaaaac

SEQ ID NO: 8861 - DNA, 32 bp, Artificial Sequence
  Synthetic polynucleotide
ttttttttgtggaaatgccactactttttttt

SEQ ID NO: 8862 - DNA, 32 bp, Artificial Sequence
  Synthetic polynucleotide
ccccggaattttttttttttttttgatattca

SEQ ID NO: 8863 - DNA, 32 bp, Artificial Sequence
  Synthetic polynucleotide
ttttttttttgatttaccgaattatttttttt

SEQ ID NO: 8864 - DNA, 32 bp, Artificial Sequence
  Synthetic polynucleotide
ggagaatctttttttttttttttttggtgtgt

SEQ ID NO: 8865 - DNA, 32 bp, Artificial Sequence
  Synthetic polynucleotide
ttttttttgctgccattctggttctttttttt

SEQ ID NO: 8866 - DNA, 32 bp, Artificial Sequence
  Synthetic polynucleotide
gctctaaattttttttttttttttcccactgt

SEQ ID NO: 8867 - DNA, 32 bp, Artificial Sequence
  Synthetic polynucleotide
tttttttttaaggaatcggacggatttttttt

SEQ ID NO: 8868 - DNA, 32 bp, Artificial Sequence
  Synthetic polynucleotide
tctgatatttttttttttttttttaaactaca

SEQ ID NO: 8869 - DNA, 32 bp, Artificial Sequence
  Synthetic polynucleotide
ttttttttctgtgctccccgagtctttttttt

SEQ ID NO: 8870 - DNA, 32 bp, Artificial Sequence
  Synthetic polynucleotide
ctggttttttttttttttttttttcagcatta

SEQ ID NO: 8871 - DNA, 32 bp, Artificial Sequence
  Synthetic polynucleotide
ttttttttgattgcgcgtaatggttttttttt

SEQ ID NO: 8872 - DNA, 32 bp, Artificial Sequence
  Synthetic polynucleotide
ccgtaatcttttttttttttttttcgtagtgg

SEQ ID NO: 8873 - DNA, 32 bp, Artificial Sequence
  Synthetic polynucleotide
ttttttttctaagccgtataaagctttttttt

SEQ ID NO: 8874 - DNA, 32 bp, Artificial Sequence; identical to SEQ ID NO: 6728
  Synthetic polynucleotide

SEQ ID NO: 8875 - DNA, 32 bp, Artificial Sequence
  Synthetic polynucleotide
ttttttttaataacttctgtatgatttttttt

SEQ ID NO: 8876 - DNA, 32 bp, Artificial Sequence
  Synthetic polynucleotide
accaatcattttttttttttttttatctatgt

SEQ ID NO: 8877 - DNA, 32 bp, Artificial Sequence
  Synthetic polynucleotide
tttttttttacactaatgcggcgctttttttt

SEQ ID NO: 8878 - DNA, 32 bp, Artificial Sequence
  Synthetic polynucleotide
gataatacttttttttttttttttcctgcgaa

SEQ ID NO: 8879 - DNA, 32 bp, Artificial Sequence
  Synthetic polynucleotide
ttttttttattgacgcccaccttatttttttt

SEQ ID NO: 8880 - DNA, 32 bp, Artificial Sequence
  Synthetic polynucleotide
ttctgctattttttttttttttttttacgagt

SEQ ID NO: 8881 - DNA, 32 bp, Artificial Sequence
  Synthetic polynucleotide
ttttttttgcaaattatacgagcttttttttt

SEQ ID NO: 8882 - DNA, 32 bp, Artificial Sequence
  Synthetic polynucleotide
cttcgtcattttttttttttttttagacctgt

SEQ ID NO: 8883 - DNA, 32 bp, Artificial Sequence
  Synthetic polynucleotide
tttttttttgacggagctagagcttttttttt

SEQ ID NO: 8884 - DNA, 32 bp, Artificial Sequence
  Synthetic polynucleotide
aggaggtgttttttttttttttttactcgccg

SEQ ID NO: 8885 - DNA, 32 bp, Artificial Sequence
  Synthetic polynucleotide
ttttttttaccctaacatagaatatttttttt

SEQ ID NO: 8886 - DNA, 32 bp, Artificial Sequence
  Synthetic polynucleotide
ctcccacatttttttttttttttttaggtcac

SEQ ID NO: 8887 - DNA, 32 bp, Artificial Sequence
  Synthetic polynucleotide
tttttttttaatgatctgtaccattttttttt

SEQ ID NO: 8888 - DNA, 32 bp, Artificial Sequence
  Synthetic polynucleotide
ggactatttttttttttttttttttatcaaag

SEQ ID NO: 8889 - DNA, 32 bp, Artificial Sequence
  Synthetic polynucleotide
ttttttttcatttcttcgcggaactttttttt

SEQ ID NO: 8890 - DNA, 32 bp, Artificial Sequence
  Synthetic polynucleotide
agtaattgtttttttttttttttttttaaacc

SEQ ID NO: 8891 - DNA, 32 bp, Artificial Sequence
  Synthetic polynucleotide
tttttttttcgctttttaacactttttttttt

SEQ ID NO: 8892 - DNA, 32 bp, Artificial Sequence
  Synthetic polynucleotide
tactggagttttttttttttttttggtctcga

SEQ ID NO: 8893 - DNA, 32 bp, Artificial Sequence
  Synthetic polynucleotide
ttttttttaatggcaaagcacgtatttttttt

SEQ ID NO: 8894 - DNA, 32 bp, Artificial Sequence
  Synthetic polynucleotide
gatgaacattttttttttttttttgagataat

SEQ ID NO: 8895 - DNA, 32 bp, Artificial Sequence
  Synthetic polynucleotide
ttttttttgggtgaccatagaatgtttttttt

SEQ ID NO: 8896 - DNA, 32 bp, Artificial Sequence
  Synthetic polynucleotide
accattgtttttttttttttttttctattgag

SEQ ID NO: 8897 - DNA, 32 bp, Artificial Sequence
  Synthetic polynucleotide
ttttttttcaaaagatgttatacatttttttt

SEQ ID NO: 8898 - DNA, 32 bp, Artificial Sequence
  Synthetic polynucleotide
cagtgcggttttttttttttttttggtccggc

SEQ ID NO: 8899 - DNA, 32 bp, Artificial Sequence
  Synthetic polynucleotide
ttttttttagtaaatgggtagaagtttttttt

SEQ ID NO: 8900 - DNA, 32 bp, Artificial Sequence
  Synthetic polynucleotide
gggagctgttttttttttttttttgaactctg

SEQ ID NO: 8901 - DNA, 32 bp, Artificial Sequence
  Synthetic polynucleotide
ttttttttacttacctcactcgcatttttttt

SEQ ID NO: 8902 - DNA, 32 bp, Artificial Sequence
  Synthetic polynucleotide
ttatattattttttttttttttttcttagatc

SEQ ID NO: 8903 - DNA, 32 bp, Artificial Sequence
  Synthetic polynucleotide
ttttttttcgcggacagcggtaactttttttt

SEQ ID NO: 8904 - DNA, 32 bp, Artificial Sequence
  Synthetic polynucleotide
acttaatattttttttttttttttatcacata

SEQ ID NO: 8905 - DNA, 32 bp, Artificial Sequence
  Synthetic polynucleotide
ttttttttcggcgaaaacttacgttttttttt

SEQ ID NO: 8906 - DNA, 32 bp, Artificial Sequence
  Synthetic polynucleotide
caggcaagttttttttttttttttgtagtgtc

SEQ ID NO: 8907 - DNA, 32 bp, Artificial Sequence
  Synthetic polynucleotide
ttttttttcacaggatctggtctctttttttt

SEQ ID NO: 8908 - DNA, 32 bp, Artificial Sequence
  Synthetic polynucleotide
attactggttttttttttttttttaaacgtcc

SEQ ID NO: 8909 - DNA, 32 bp, Artificial Sequence
  Synthetic polynucleotide
ttttttttttcaggctacctatattttttttt

SEQ ID NO: 8910 - DNA, 32 bp, Artificial Sequence
  Synthetic polynucleotide
aatgttctttttttttttttttttagccattt

SEQ ID NO: 8911 - DNA, 32 bp, Artificial Sequence
  Synthetic polynucleotide
ttttttttcgaacccgaactcatatttttttt

SEQ ID NO: 8912 - DNA, 32 bp, Artificial Sequence
  Synthetic polynucleotide
gcagggtgtttttttttttttttttacgtctt

SEQ ID NO: 8913 - DNA, 32 bp, Artificial Sequence
  Synthetic polynucleotide
ttttttttccgtcgatcgaccatttttttttt

SEQ ID NO: 8914 - DNA, 32 bp, Artificial Sequence
  Synthetic polynucleotide
gagctcacttttttttttttttttggtcattg

SEQ ID NO: 8915 - DNA, 32 bp, Artificial Sequence
  Synthetic polynucleotide
ttttttttaaaaatcactgctccttttttttt

SEQ ID NO: 8916 - DNA, 32 bp, Artificial Sequence
  Synthetic polynucleotide
gccgatggttttttttttttttttttagggtc

SEQ ID NO: 8917 - DNA, 32 bp, Artificial Sequence
  Synthetic polynucleotide
tttttttttcaatttttaccgagctttttttt

SEQ ID NO: 8918 - DNA, 32 bp, Artificial Sequence
  Synthetic polynucleotide
ctagtaacttttttttttttttttaaagtatt

SEQ ID NO: 8919 - DNA, 32 bp, Artificial Sequence
  Synthetic polynucleotide
ttttttttcaaggcgcgaatatcctttttttt

SEQ ID NO: 8920 - DNA, 32 bp, Artificial Sequence
  Synthetic polynucleotide
cctaggcgttttttttttttttttccggttga

SEQ ID NO: 8921 - DNA, 32 bp, Artificial Sequence
  Synthetic polynucleotide
ttttttttgaggttagcgctgatctttttttt

SEQ ID NO: 8922 - DNA, 32 bp, Artificial Sequence
  Synthetic polynucleotide
cgtttattttttttttttttttttcggtttac

SEQ ID NO: 8923 - DNA, 32 bp, Artificial Sequence
  Synthetic polynucleotide
ttttttttttatgtgaccccttcgtttttttt

SEQ ID NO: 8924 - DNA, 32 bp, Artificial Sequence
  Synthetic polynucleotide
aagagcaatttttttttttttttttttaaaga

SEQ ID NO: 8925 - DNA, 32 bp, Artificial Sequence
  Synthetic polynucleotide
ttttttttagacgtcctggctcgttttttttt

SEQ ID NO: 8926 - DNA, 32 bp, Artificial Sequence
  Synthetic polynucleotide
ctgaaggattttttttttttttttacccatcc

SEQ ID NO: 8927 - DNA, 32 bp, Artificial Sequence
  Synthetic polynucleotide
tttttttttaggcggaagatgcgatttttttt

SEQ ID NO: 8928 - DNA, 32 bp, Artificial Sequence
  Synthetic polynucleotide
agggttcatttttttttttttttttttgtacg

SEQ ID NO: 8929 - DNA, 32 bp, Artificial Sequence
  Synthetic polynucleotide
ttttttttcgatagtagaaaactgtttttttt

SEQ ID NO: 8930 - DNA, 32 bp, Artificial Sequence
  Synthetic polynucleotide
taggcaagttttttttttttttttcacaactt

SEQ ID NO: 8931 - DNA, 32 bp, Artificial Sequence
  Synthetic polynucleotide
tttttttttaagaacacccgacaatttttttt

SEQ ID NO: 8932 - DNA, 32 bp, Artificial Sequence
  Synthetic polynucleotide
cctagaacttttttttttttttttggcagcag

SEQ ID NO: 8933 - DNA, 32 bp, Artificial Sequence
  Synthetic polynucleotide
ttttttttccccgctccaacattttttttttt

SEQ ID NO: 8934 - DNA, 32 bp, Artificial Sequence
  Synthetic polynucleotide
tggtcggttttttttttttttttttatctctt

SEQ ID NO: 8935 - DNA, 32 bp, Artificial Sequence
  Synthetic polynucleotide
tttttttttagcgcctgcgcgggctttttttt

SEQ ID NO: 8936 - DNA, 32 bp, Artificial Sequence
  Synthetic polynucleotide
tgggagaatttttttttttttttttgactctt

SEQ ID NO: 8937 - DNA, 32 bp, Artificial Sequence
  Synthetic polynucleotide
tttttttttatccatttgatcctgtttttttt

SEQ ID NO: 8938 - DNA, 32 bp, Artificial Sequence
  Synthetic polynucleotide
ggtattttttttttttttttttttcgtacctt

SEQ ID NO: 8939 - DNA, 32 bp, Artificial Sequence
  Synthetic polynucleotide
ttttttttgatgcgttgatgatattttttttt

SEQ ID NO: 8940 - DNA, 32 bp, Artificial Sequence
  Synthetic polynucleotide
gcccgacgttttttttttttttttggtaatcc

SEQ ID NO: 8941 - DNA, 32 bp, Artificial Sequence
  Synthetic polynucleotide
ttttttttcgaaggtcgccagtagtttttttt

SEQ ID NO: 8942 - DNA, 32 bp, Artificial Sequence
  Synthetic polynucleotide
acctaatgttttttttttttttttgccgggct

SEQ ID NO: 8943 - DNA, 32 bp, Artificial Sequence
  Synthetic polynucleotide
tttttttttataataggctgatgctttttttt

SEQ ID NO: 8944 - DNA, 32 bp, Artificial Sequence
  Synthetic polynucleotide
gatatcgcttttttttttttttttcctgcttc

SEQ ID NO: 8945 - DNA, 32 bp, Artificial Sequence
  Synthetic polynucleotide
ttttttttcgcattcaccatatgatttttttt

SEQ ID NO: 8946 - DNA, 32 bp, Artificial Sequence
  Synthetic polynucleotide
acagtgccttttttttttttttttcttgtact

SEQ ID NO: 8947 - DNA, 32 bp, Artificial Sequence
  Synthetic polynucleotide
ttttttttacactcaccccgcgtatttttttt

SEQ ID NO: 8948 - DNA, 32 bp, Artificial Sequence
  Synthetic polynucleotide
tattgaagtttttttttttttttttcgggaca

SEQ ID NO: 8949 - DNA, 32 bp, Artificial Sequence
  Synthetic polynucleotide
ttttttttctacaactgcactaagtttttttt

SEQ ID NO: 8950 - DNA, 32 bp, Artificial Sequence
  Synthetic polynucleotide
aggtcatcttttttttttttttttcgcctccg

SEQ ID NO: 8951 - DNA, 32 bp, Artificial Sequence
  Synthetic polynucleotide
ttttttttaggctgcgaagttgaatttttttt

SEQ ID NO: 8952 - DNA, 32 bp, Artificial Sequence
  Synthetic polynucleotide
ttacacattttttttttttttttttcgtctac

SEQ ID NO: 8953 - DNA, 32 bp, Artificial Sequence
  Synthetic polynucleotide
ttttttttgcccaccacgtcccattttttttt

SEQ ID NO: 8954 - DNA, 32 bp, Artificial Sequence
  Synthetic polynucleotide
gctgtgccttttttttttttttttattttata

SEQ ID NO: 8955 - DNA, 32 bp, Artificial Sequence
  Synthetic polynucleotide
ttttttttatgtgaagcgatgctttttttttt

SEQ ID NO: 8956 - DNA, 32 bp, Artificial Sequence
  Synthetic polynucleotide
caaagggcttttttttttttttttttgccaca

SEQ ID NO: 8957 - DNA, 32 bp, Artificial Sequence
  Synthetic polynucleotide
ttttttttgtgaaccctaacagcatttttttt

SEQ ID NO: 8958 - DNA, 32 bp, Artificial Sequence
  Synthetic polynucleotide
aggatggcttttttttttttttttggtcggcc

SEQ ID NO: 8959 - DNA, 32 bp, Artificial Sequence
  Synthetic polynucleotide
ttttttttaagcgggtacatgaggtttttttt

SEQ ID NO: 8960 - DNA, 32 bp, Artificial Sequence
  Synthetic polynucleotide
tttacgcttttttttttttttttttggctggt

SEQ ID NO: 8961 - DNA, 32 bp, Artificial Sequence
  Synthetic polynucleotide
ttttttttgtcaagacataccctatttttttt

SEQ ID NO: 8962 - DNA, 32 bp, Artificial Sequence
  Synthetic polynucleotide
gtggcgctttttttttttttttttttgtcgtt

SEQ ID NO: 8963 - DNA, 32 bp, Artificial Sequence
  Synthetic polynucleotide
ttttttttttgttcatacttggactttttttt

SEQ ID NO: 8964 - DNA, 32 bp, Artificial Sequence
  Synthetic polynucleotide
acgggacattttttttttttttttaaagtgag

SEQ ID NO: 8965 - DNA, 32 bp, Artificial Sequence
  Synthetic polynucleotide
ttttttttgccctaacagtgtttttttttttt

SEQ ID NO: 8966 - DNA, 32 bp, Artificial Sequence
  Synthetic polynucleotide
acattactttttttttttttttttatgctggg

SEQ ID NO: 8967 - DNA, 32 bp, Artificial Sequence
  Synthetic polynucleotide
ttttttttggcactagcgtgacggtttttttt

SEQ ID NO: 8968 - DNA, 32 bp, Artificial Sequence
  Synthetic polynucleotide
agtaacgctttttttttttttttttgaatctt

SEQ ID NO: 8969 - DNA, 32 bp, Artificial Sequence
  Synthetic polynucleotide
ttttttttagcgggtcatcatgagtttttttt

SEQ ID NO: 8970 - DNA, 32 bp, Artificial Sequence
  Synthetic polynucleotide
cataccgtttttttttttttttttttttttgt

SEQ ID NO: 8971 - DNA, 32 bp, Artificial Sequence
  Synthetic polynucleotide
ttttttttgcgtagctgatagagatttttttt

SEQ ID NO: 8972 - DNA, 32 bp, Artificial Sequence
  Synthetic polynucleotide
ggggactcttttttttttttttttactgtccc

SEQ ID NO: 8973 - DNA, 32 bp, Artificial Sequence
  Synthetic polynucleotide
tttttttttattcttcttctgaattttttttt

SEQ ID NO: 8974 - DNA, 32 bp, Artificial Sequence
  Synthetic polynucleotide
ctgaatggttttttttttttttttcgcgggct

SEQ ID NO: 8975 - DNA, 32 bp, Artificial Sequence
  Synthetic polynucleotide
ttttttttcctgtgaaatcccggatttttttt

SEQ ID NO: 8976 - DNA, 32 bp, Artificial Sequence
  Synthetic polynucleotide
actcgtcgtttttttttttttttttcttgtat

SEQ ID NO: 8977 - DNA, 32 bp, Artificial Sequence
  Synthetic polynucleotide
ttttttttatgccgttcgtaggagtttttttt

SEQ ID NO: 8978 - DNA, 32 bp, Artificial Sequence
  Synthetic polynucleotide
agacatagttttttttttttttttttgaccta

SEQ ID NO: 8979 - DNA, 32 bp, Artificial Sequence
  Synthetic polynucleotide
ttttttttaggcctcgcttggacatttttttt

SEQ ID NO: 8980 - DNA, 32 bp, Artificial Sequence
  Synthetic polynucleotide
tattgctcttttttttttttttttttgcgctt

SEQ ID NO: 8981 - DNA, 32 bp, Artificial Sequence
  Synthetic polynucleotide
tttttttttcaatttccttccatgtttttttt

SEQ ID NO: 8982 - DNA, 32 bp, Artificial Sequence
  Synthetic polynucleotide
cttacttgtttttttttttttttttaattata

SEQ ID NO: 8983 - DNA, 32 bp, Artificial Sequence
  Synthetic polynucleotide
ttttttttacgccctgttaaccattttttttt

SEQ ID NO: 8984 - DNA, 32 bp, Artificial Sequence
  Synthetic polynucleotide
gctcattcttttttttttttttttaaggtccg

SEQ ID NO: 8985 - DNA, 32 bp, Artificial Sequence
  Synthetic polynucleotide
ttttttttggtgcgtcgaccacgttttttttt

SEQ ID NO: 8986 - DNA, 32 bp, Artificial Sequence
  Synthetic polynucleotide
ccagcagtttttttttttttttttcctctcct

SEQ ID NO: 8987 - DNA, 32 bp, Artificial Sequence
  Synthetic polynucleotide
ttttttttcccggtcacgcgagactttttttt

SEQ ID NO: 8988 - DNA, 32 bp, Artificial Sequence
  Synthetic polynucleotide
ctccgcatttttttttttttttttcctcacgc

SEQ ID NO: 8989 - DNA, 32 bp, Artificial Sequence
  Synthetic polynucleotide
ttttttttgcctacctacacagtgtttttttt

SEQ ID NO: 8990 - DNA, 32 bp, Artificial Sequence
  Synthetic polynucleotide
taacaaggtttttttttttttttttgcagggt

SEQ ID NO: 8991 - DNA, 32 bp, Artificial Sequence
  Synthetic polynucleotide
tttttttttgccatcgttttaacatttttttt

SEQ ID NO: 8992 - DNA, 32 bp, Artificial Sequence
  Synthetic polynucleotide
gcgacgctttttttttttttttttcatacatg

SEQ ID NO: 8993 - DNA, 32 bp, Artificial Sequence
  Synthetic polynucleotide
ttttttttcactttaagagccgattttttttt

SEQ ID NO: 8994 - DNA, 32 bp, Artificial Sequence
  Synthetic polynucleotide
gaaggctgttttttttttttttttggagtgtt

SEQ ID NO: 8995 - DNA, 32 bp, Artificial Sequence
  Synthetic polynucleotide
ttttttttcttggtaacacaaaactttttttt

SEQ ID NO: 8996 - DNA, 32 bp, Artificial Sequence
  Synthetic polynucleotide
cggcgccgtttttttttttttttttgccaatg

SEQ ID NO: 8997 - DNA, 32 bp, Artificial Sequence
  Synthetic polynucleotide
tttttttttgatcaatatcggatttttttttt

SEQ ID NO: 8998 - DNA, 32 bp, Artificial Sequence
  Synthetic polynucleotide
ggttgcggttttttttttttttttccggcgga

SEQ ID NO: 8999 - DNA, 32 bp, Artificial Sequence
  Synthetic polynucleotide
ttttttttcacgtaaacaggtggttttttttt

SEQ ID NO: 9000 - DNA, 32 bp, Artificial Sequence
  Synthetic polynucleotide
cccggtggttttttttttttttttctctgata

SEQ ID NO: 9001 - DNA, 32 bp, Artificial Sequence
  Synthetic polynucleotide
ttttttttggaacagactgctttttttttttt

SEQ ID NO: 9002 - DNA, 32 bp, Artificial Sequence
  Synthetic polynucleotide
gttgttcctttttttttttttttttataaaaa

SEQ ID NO: 9003 - DNA, 32 bp, Artificial Sequence
  Synthetic polynucleotide
ttttttttcgggcatcagtcaatctttttttt

SEQ ID NO: 9004 - DNA, 32 bp, Artificial Sequence
  Synthetic polynucleotide
atgttccgtttttttttttttttttccccgga

SEQ ID NO: 9005 - DNA, 32 bp, Artificial Sequence
  Synthetic polynucleotide
ttttttttcatcgtgccgtgggactttttttt

SEQ ID NO: 9006 - DNA, 32 bp, Artificial Sequence
  Synthetic polynucleotide
gcggcgaattttttttttttttttattccacg

SEQ ID NO: 9007 - DNA, 32 bp, Artificial Sequence
  Synthetic polynucleotide
ttttttttaaaacgaccgggtatatttttttt

SEQ ID NO: 9008 - DNA, 32 bp, Artificial Sequence
  Synthetic polynucleotide
ctgctgaattttttttttttttttggagcgta

SEQ ID NO: 9009 - DNA, 32 bp, Artificial Sequence
  Synthetic polynucleotide
ttttttttgagtaagggctaagggtttttttt

SEQ ID NO: 9010 - DNA, 32 bp, Artificial Sequence
  Synthetic polynucleotide
gccaaaatttttttttttttttttttttgcat

SEQ ID NO: 9011 - DNA, 32 bp, Artificial Sequence
  Synthetic polynucleotide
ttttttttccatgcgattgttgcgtttttttt

SEQ ID NO: 9012 - DNA, 32 bp, Artificial Sequence
  Synthetic polynucleotide
gcgccagattttttttttttttttgcctcgtg

SEQ ID NO: 9013 - DNA, 32 bp, Artificial Sequence
  Synthetic polynucleotide
ttttttttctaagccggacccaggtttttttt

SEQ ID NO: 9014 - DNA, 32 bp, Artificial Sequence
  Synthetic polynucleotide
ggcggatatttttttttttttttttaggttat

SEQ ID NO: 9015 - DNA, 32 bp, Artificial Sequence
  Synthetic polynucleotide
ttttttttgcgagatatagatgcgtttttttt

SEQ ID NO: 9016 - DNA, 32 bp, Artificial Sequence
  Synthetic polynucleotide
cgtcctgtttttttttttttttttactacacc

SEQ ID NO: 9017 - DNA, 32 bp, Artificial Sequence
  Synthetic polynucleotide
ttttttttgagaacattcacatactttttttt

SEQ ID NO: 9018 - DNA, 32 bp, Artificial Sequence
  Synthetic polynucleotide
cagagatgttttttttttttttttcagctgga

SEQ ID NO: 9019 - DNA, 32 bp, Artificial Sequence
  Synthetic polynucleotide
ttttttttaacggtttagcgtgattttttttt

SEQ ID NO: 9020 - DNA, 32 bp, Artificial Sequence
  Synthetic polynucleotide
atattgtattttttttttttttttgcaggcgt

SEQ ID NO: 9021 - DNA, 32 bp, Artificial Sequence
  Synthetic polynucleotide
ttttttttatataactccatattatttttttt

SEQ ID NO: 9022 - DNA, 32 bp, Artificial Sequence
  Synthetic polynucleotide
accttcaattttttttttttttttacctgcca

SEQ ID NO: 9023 - DNA, 32 bp, Artificial Sequence
  Synthetic polynucleotide
tttttttttggttcaacgatgcggtttttttt

SEQ ID NO: 9024 - DNA, 32 bp, Artificial Sequence
  Synthetic polynucleotide
gactctctttttttttttttttttgcgagggt

SEQ ID NO: 9025 - DNA, 32 bp, Artificial Sequence
  Synthetic polynucleotide
ttttttttagggctgcgcatgagatttttttt

SEQ ID NO: 9026 - DNA, 32 bp, Artificial Sequence
  Synthetic polynucleotide
ctcaataattttttttttttttttggcgcaga

SEQ ID NO: 9027 - DNA, 32 bp, Artificial Sequence
  Synthetic polynucleotide
ttttttttttgcggggagtgtggttttttttt

SEQ ID NO: 9028 - DNA, 32 bp, Artificial Sequence
  Synthetic polynucleotide
ttgtgaacttttttttttttttttctgtttaa

SEQ ID NO: 9029 - DNA, 32 bp, Artificial Sequence
  Synthetic polynucleotide
tttttttttaacggccgactctactttttttt

SEQ ID NO: 9030 - DNA, 32 bp, Artificial Sequence
  Synthetic polynucleotide
ctgtactattttttttttttttttcctgggaa

SEQ ID NO: 9031 - DNA, 32 bp, Artificial Sequence
  Synthetic polynucleotide
ttttttttatcgctgacatcttaatttttttt

SEQ ID NO: 9032 - DNA, 32 bp, Artificial Sequence
  Synthetic polynucleotide
atcccctcttttttttttttttttcgaccgtt

SEQ ID NO: 9033 - DNA, 32 bp, Artificial Sequence
  Synthetic polynucleotide
ttttttttgtagttaaagaactcttttttttt

SEQ ID NO: 9034 - DNA, 32 bp, Artificial Sequence
  Synthetic polynucleotide
cgatagaatttttttttttttttttgatgtcc

SEQ ID NO: 9035 - DNA, 32 bp, Artificial Sequence
  Synthetic polynucleotide
tttttttttcaccctacatacacatttttttt

SEQ ID NO: 9036 - DNA, 32 bp, Artificial Sequence
  Synthetic polynucleotide
ttgtcttattttttttttttttttccacaatg

SEQ ID NO: 9037 - DNA, 32 bp, Artificial Sequence
  Synthetic polynucleotide
ttttttttaccgtgggaaactgagtttttttt

SEQ ID NO: 9038 - DNA, 32 bp, Artificial Sequence
  Synthetic polynucleotide
tcatggtatttttttttttttttttaagacct

SEQ ID NO: 9039 - DNA, 32 bp, Artificial Sequence
  Synthetic polynucleotide
tttttttttggagtaggttagtggtttttttt

SEQ ID NO: 9040 - DNA, 32 bp, Artificial Sequence
  Synthetic polynucleotide
cacttgactttttttttttttttttggcaccc

SEQ ID NO: 9041 - DNA, 32 bp, Artificial Sequence
  Synthetic polynucleotide
ttttttttgcgaccgatccctaaatttttttt

SEQ ID NO: 9042 - DNA, 32 bp, Artificial Sequence
  Synthetic polynucleotide
agacgccttttttttttttttttttgtccgtg

SEQ ID NO: 9043 - DNA, 32 bp, Artificial Sequence
  Synthetic polynucleotide
ttttttttggggatgatttgcacctttttttt

SEQ ID NO: 9044 - DNA, 32 bp, Artificial Sequence
  Synthetic polynucleotide
gctctggattttttttttttttttacctatac

SEQ ID NO: 9045 - DNA, 32 bp, Artificial Sequence
  Synthetic polynucleotide
tttttttttaggtgctaatattgctttttttt

SEQ ID NO: 9046 - DNA, 32 bp, Artificial Sequence
  Synthetic polynucleotide
agacgtttttttttttttttttttagtattcc

SEQ ID NO: 9047 - DNA, 32 bp, Artificial Sequence
  Synthetic polynucleotide
tttttttttgtcctatgtttacttagggatgg

SEQ ID NO: 9048 - DNA, 32 bp, Artificial Sequence
  Synthetic polynucleotide
aactgttgttttttttgtttacttagggatgg

SEQ ID NO: 9049 - DNA, 32 bp, Artificial Sequence
  Synthetic polynucleotide
aactgttgtgtcctatttttttttagggatgg

SEQ ID NO: 9050 - DNA, 32 bp, Artificial Sequence
  Synthetic polynucleotide
aactgttgtgtcctatgtttactttttttttt

SEQ ID NO: 9051 - DNA, 32 bp, Artificial Sequence
  Synthetic polynucleotide
ttttttttcaacgcacgctcgggtagtctcaa

SEQ ID NO: 9052 - DNA, 32 bp, Artificial Sequence
  Synthetic polynucleotide
tacgaactttttttttgctcgggtagtctcaa

SEQ ID NO: 9053 - DNA, 32 bp, Artificial Sequence
  Synthetic polynucleotide
tacgaactcaacgcacttttttttagtctcaa

SEQ ID NO: 9054 - DNA, 32 bp, Artificial Sequence
  Synthetic polynucleotide
tacgaactcaacgcacgctcgggttttttttt

SEQ ID NO: 9055 - DNA, 32 bp, Artificial Sequence
  Synthetic polynucleotide
ttttttttagagcataaattcgctaaaccgga

SEQ ID NO: 9056 - DNA, 32 bp, Artificial Sequence
  Synthetic polynucleotide
gaagatagttttttttaattcgctaaaccgga

SEQ ID NO: 9057 - DNA, 32 bp, Artificial Sequence
  Synthetic polynucleotide
gaagatagagagcatattttttttaaaccgga

SEQ ID NO: 9058 - DNA, 32 bp, Artificial Sequence
  Synthetic polynucleotide
gaagatagagagcataaattcgcttttttttt

SEQ ID NO: 9059 - DNA, 32 bp, Artificial Sequence
  Synthetic polynucleotide
ttttttttcgcatctcactcagtgatcgagta

SEQ ID NO: 9060 - DNA, 32 bp, Artificial Sequence
  Synthetic polynucleotide
aaagtatcttttttttactcagtgatcgagta

SEQ ID NO: 9061 - DNA, 32 bp, Artificial Sequence
  Synthetic polynucleotide
aaagtatccgcatctcttttttttatcgagta

SEQ ID NO: 9062 - DNA, 32 bp, Artificial Sequence
  Synthetic polynucleotide
aaagtatccgcatctcactcagtgtttttttt

SEQ ID NO: 9063 - DNA, 32 bp, Artificial Sequence
  Synthetic polynucleotide
ttttttttgccttttcgaacggtgacacactt

SEQ ID NO: 9064 - DNA, 32 bp, Artificial Sequence
  Synthetic polynucleotide
ttcatgtcttttttttgaacggtgacacactt

SEQ ID NO: 9065 - DNA, 32 bp, Artificial Sequence
  Synthetic polynucleotide
ttcatgtcgccttttcttttttttacacactt

SEQ ID NO: 9066 - DNA, 32 bp, Artificial Sequence
  Synthetic polynucleotide
ttcatgtcgccttttcgaacggtgtttttttt

SEQ ID NO: 9067 - DNA, 32 bp, Artificial Sequence
  Synthetic polynucleotide
tttttttttcagagtagcggaaatatggccgc

SEQ ID NO: 9068 - DNA, 32 bp, Artificial Sequence
  Synthetic polynucleotide
gtgttcatttttttttgcggaaatatggccgc

SEQ ID NO: 9069 - DNA, 32 bp, Artificial Sequence
  Synthetic polynucleotide
gtgttcattcagagtattttttttatggccgc

SEQ ID NO: 9070 - DNA, 32 bp, Artificial Sequence
  Synthetic polynucleotide
gtgttcattcagagtagcggaaattttttttt

SEQ ID NO: 9071 - DNA, 32 bp, Artificial Sequence
  Synthetic polynucleotide
ttttttttgcagcgggccgcctgtaacgctta

SEQ ID NO: 9072 - DNA, 32 bp, Artificial Sequence
  Synthetic polynucleotide
ttcggtgcttttttttccgcctgtaacgctta

SEQ ID NO: 9073 - DNA, 32 bp, Artificial Sequence
  Synthetic polynucleotide
ttcggtgcgcagcgggttttttttaacgctta

SEQ ID NO: 9074 - DNA, 32 bp, Artificial Sequence
  Synthetic polynucleotide
ttcggtgcgcagcgggccgcctgttttttttt

SEQ ID NO: 9075 - DNA, 32 bp, Artificial Sequence
  Synthetic polynucleotide
ttttttttgggcttttgctaatacgctgagcg

SEQ ID NO: 9076 - DNA, 32 bp, Artificial Sequence
  Synthetic polynucleotide
atcagcccttttttttgctaatacgctgagcg

SEQ ID NO: 9077 - DNA, 32 bp, Artificial Sequence
  Synthetic polynucleotide
atcagcccgggcttttttttttttgctgagcg

SEQ ID NO: 9078 - DNA, 32 bp, Artificial Sequence
  Synthetic polynucleotide
atcagcccgggcttttgctaatactttttttt

SEQ ID NO: 9079 - DNA, 32 bp, Artificial Sequence
  Synthetic polynucleotide
ttttttttgttgcggggtttctgaaccggaac

SEQ ID NO: 9080 - DNA, 32 bp, Artificial Sequence
  Synthetic polynucleotide
atgctgttttttttttgtttctgaaccggaac

SEQ ID NO: 9081 - DNA, 32 bp, Artificial Sequence
  Synthetic polynucleotide
atgctgttgttgcgggttttttttaccggaac

SEQ ID NO: 9082 - DNA, 32 bp, Artificial Sequence
  Synthetic polynucleotide
atgctgttgttgcggggtttctgatttttttt

SEQ ID NO: 9083 - DNA, 32 bp, Artificial Sequence
  Synthetic polynucleotide
ttttttttatgaagccgtgaccccagagactg

SEQ ID NO: 9084 - DNA, 32 bp, Artificial Sequence
  Synthetic polynucleotide
ccgggctattttttttgtgaccccagagactg

SEQ ID NO: 9085 - DNA, 32 bp, Artificial Sequence
  Synthetic polynucleotide
ccgggctaatgaagccttttttttagagactg

SEQ ID NO: 9086 - DNA, 32 bp, Artificial Sequence
  Synthetic polynucleotide
ccgggctaatgaagccgtgacccctttttttt

SEQ ID NO: 9087 - DNA, 32 bp, Artificial Sequence
  Synthetic polynucleotide
ttttttttaccgggagccagccacttagctgt

SEQ ID NO: 9088 - DNA, 32 bp, Artificial Sequence
  Synthetic polynucleotide
tctgatgcttttttttccagccacttagctgt

SEQ ID NO: 9089 - DNA, 32 bp, Artificial Sequence
  Synthetic polynucleotide
tctgatgcaccgggagttttttttttagctgt

SEQ ID NO: 9090 - DNA, 32 bp, Artificial Sequence
  Synthetic polynucleotide
tctgatgcaccgggagccagccactttttttt

SEQ ID NO: 9091 - DNA, 32 bp, Artificial Sequence
  Synthetic polynucleotide
ttttttttgatcgcgagttccctctagctagg

SEQ ID NO: 9092 - DNA, 32 bp, Artificial Sequence
  Synthetic polynucleotide
gtcagtgtttttttttgttccctctagctagg

SEQ ID NO: 9093 - DNA, 32 bp, Artificial Sequence
  Synthetic polynucleotide
gtcagtgtgatcgcgatttttttttagctagg

SEQ ID NO: 9094 - DNA, 32 bp, Artificial Sequence
  Synthetic polynucleotide
gtcagtgtgatcgcgagttccctctttttttt

SEQ ID NO: 9095 - DNA, 32 bp, Artificial Sequence
  Synthetic polynucleotide
ttttttttaaaagggtggatatggagctggaa

SEQ ID NO: 9096 - DNA, 32 bp, Artificial Sequence
  Synthetic polynucleotide
gtgatgccttttttttggatatggagctggaa

SEQ ID NO: 9097 - DNA, 32 bp, Artificial Sequence
  Synthetic polynucleotide
gtgatgccaaaagggtttttttttagctggaa

SEQ ID NO: 9098 - DNA, 32 bp, Artificial Sequence
  Synthetic polynucleotide
gtgatgccaaaagggtggatatggtttttttt

SEQ ID NO: 9099 - DNA, 32 bp, Artificial Sequence
  Synthetic polynucleotide
ttttttttatttctagtgacctggtataatgg

SEQ ID NO: 9100 - DNA, 32 bp, Artificial Sequence
  Synthetic polynucleotide
cggctctgtttttttttgacctggtataatgg

SEQ ID NO: 9101 - DNA, 32 bp, Artificial Sequence
  Synthetic polynucleotide
cggctctgatttctagtttttttttataatgg

SEQ ID NO: 9102 - DNA, 32 bp, Artificial Sequence
  Synthetic polynucleotide
cggctctgatttctagtgacctggtttttttt

SEQ ID NO: 9103 - DNA, 32 bp, Artificial Sequence
  Synthetic polynucleotide
ttttttttcctgacctcaatcatacgtcccac

SEQ ID NO: 9104 - DNA, 32 bp, Artificial Sequence
  Synthetic polynucleotide
cggagctattttttttcaatcatacgtcccac

SEQ ID NO: 9105 - DNA, 32 bp, Artificial Sequence
  Synthetic polynucleotide
cggagctacctgacctttttttttcgtcccac

SEQ ID NO: 9106 - DNA, 32 bp, Artificial Sequence
  Synthetic polynucleotide
cggagctacctgacctcaatcatatttttttt

SEQ ID NO: 9107 - DNA, 32 bp, Artificial Sequence
  Synthetic polynucleotide
tttttttttcatcccctttaagaatgatcgca

SEQ ID NO: 9108 - DNA, 32 bp, Artificial Sequence
  Synthetic polynucleotide
ggaaggattttttttttttaagaatgatcgca

SEQ ID NO: 9109 - DNA, 32 bp, Artificial Sequence
  Synthetic polynucleotide
ggaaggattcatcccctttttttttgatcgca

SEQ ID NO: 9110 - DNA, 32 bp, Artificial Sequence
  Synthetic polynucleotide
ggaaggattcatcccctttaagaatttttttt

SEQ ID NO: 9111 - DNA, 32 bp, Artificial Sequence
  Synthetic polynucleotide
ttttttttgagatgttgaacatcttttggttg

SEQ ID NO: 9112 - DNA, 32 bp, Artificial Sequence
  Synthetic polynucleotide
cagtctttttttttttgaacatcttttggttg

SEQ ID NO: 9113 - DNA, 32 bp, Artificial Sequence
  Synthetic polynucleotide
cagtctttgagatgtttttttttttttggttg

SEQ ID NO: 9114 - DNA, 32 bp, Artificial Sequence
  Synthetic polynucleotide
cagtctttgagatgttgaacatcttttttttt

SEQ ID NO: 9115 - DNA, 32 bp, Artificial Sequence
  Synthetic polynucleotide
ttttttttatctcgcattctggtgccaaaact

SEQ ID NO: 9116 - DNA, 32 bp, Artificial Sequence
  Synthetic polynucleotide
gcgtaaagttttttttttctggtgccaaaact

SEQ ID NO: 9117 - DNA, 32 bp, Artificial Sequence
  Synthetic polynucleotide
gcgtaaagatctcgcattttttttccaaaact

SEQ ID NO: 9118 - DNA, 32 bp, Artificial Sequence
  Synthetic polynucleotide
gcgtaaagatctcgcattctggtgtttttttt

SEQ ID NO: 9119 - DNA, 32 bp, Artificial Sequence
  Synthetic polynucleotide
ttttttttgttcaagcactattatctggctat

SEQ ID NO: 9120 - DNA, 32 bp, Artificial Sequence
  Synthetic polynucleotide
gccgactcttttttttactattatctggctat

SEQ ID NO: 9121 - DNA, 32 bp, Artificial Sequence
  Synthetic polynucleotide
gccgactcgttcaagcttttttttctggctat

SEQ ID NO: 9122 - DNA, 32 bp, Artificial Sequence
  Synthetic polynucleotide
gccgactcgttcaagcactattattttttttt

SEQ ID NO: 9123 - DNA, 32 bp, Artificial Sequence
  Synthetic polynucleotide
tttttttttctgtcagcccaagcttagcataa

SEQ ID NO: 9124 - DNA, 32 bp, Artificial Sequence
  Synthetic polynucleotide
aaaagatgttttttttcccaagcttagcataa

SEQ ID NO: 9125 - DNA, 32 bp, Artificial Sequence
  Synthetic polynucleotide
aaaagatgtctgtcagtttttttttagcataa

SEQ ID NO: 9126 - DNA, 32 bp, Artificial Sequence
  Synthetic polynucleotide
aaaagatgtctgtcagcccaagcttttttttt

SEQ ID NO: 9127 - DNA, 32 bp, Artificial Sequence
  Synthetic polynucleotide
ttttttttacgaccccgccgtgcgacgactga

SEQ ID NO: 9128 - DNA, 32 bp, Artificial Sequence
  Synthetic polynucleotide
gcggctggttttttttgccgtgcgacgactga

SEQ ID NO: 9129 - DNA, 32 bp, Artificial Sequence
  Synthetic polynucleotide
gcggctggacgaccccttttttttacgactga

SEQ ID NO: 9130 - DNA, 32 bp, Artificial Sequence
  Synthetic polynucleotide
gcggctggacgaccccgccgtgcgtttttttt

SEQ ID NO: 9131 - DNA, 32 bp, Artificial Sequence
  Synthetic polynucleotide
ttttttttcatatcctcggcccgccaaattaa

SEQ ID NO: 9132 - DNA, 32 bp, Artificial Sequence
  Synthetic polynucleotide
gacaaacgttttttttcggcccgccaaattaa

SEQ ID NO: 9133 - DNA, 32 bp, Artificial Sequence
  Synthetic polynucleotide
gacaaacgcatatcctttttttttcaaattaa

SEQ ID NO: 9134 - DNA, 32 bp, Artificial Sequence
  Synthetic polynucleotide
gacaaacgcatatcctcggcccgctttttttt

SEQ ID NO: 9135 - DNA, 32 bp, Artificial Sequence
  Synthetic polynucleotide
ttttttttgtccttccacggtaatcgggggtg

SEQ ID NO: 9136 - DNA, 32 bp, Artificial Sequence
  Synthetic polynucleotide
gcctaaagttttttttacggtaatcgggggtg

SEQ ID NO: 9137 - DNA, 32 bp, Artificial Sequence
  Synthetic polynucleotide
gcctaaaggtccttccttttttttcgggggtg

SEQ ID NO: 9138 - DNA, 32 bp, Artificial Sequence
  Synthetic polynucleotide
gcctaaaggtccttccacggtaattttttttt

SEQ ID NO: 9139 - DNA, 32 bp, Artificial Sequence
  Synthetic polynucleotide
tttttttttcgaacgaggactgttctacatag

SEQ ID NO: 9140 - DNA, 32 bp, Artificial Sequence
  Synthetic polynucleotide
acgactcgttttttttggactgttctacatag

SEQ ID NO: 9141 - DNA, 32 bp, Artificial Sequence
  Synthetic polynucleotide
acgactcgtcgaacgattttttttctacatag

SEQ ID NO: 9142 - DNA, 32 bp, Artificial Sequence
  Synthetic polynucleotide
acgactcgtcgaacgaggactgtttttttttt

SEQ ID NO: 9143 - DNA, 32 bp, Artificial Sequence
  Synthetic polynucleotide
ttttttttacgaggtttcactgggcgctatac

SEQ ID NO: 9144 - DNA, 32 bp, Artificial Sequence
  Synthetic polynucleotide
tgacttggtttttttttcactgggcgctatac

SEQ ID NO: 9145 - DNA, 32 bp, Artificial Sequence
  Synthetic polynucleotide
tgacttggacgaggttttttttttcgctatac

SEQ ID NO: 9146 - DNA, 32 bp, Artificial Sequence
  Synthetic polynucleotide
tgacttggacgaggtttcactgggtttttttt

SEQ ID NO: 9147 - DNA, 32 bp, Artificial Sequence
  Synthetic polynucleotide
ttttttttcgaggggctccctgtctgtcgagc

SEQ ID NO: 9148 - DNA, 32 bp, Artificial Sequence
  Synthetic polynucleotide
aggaaacttttttttttccctgtctgtcgagc

SEQ ID NO: 9149 - DNA, 32 bp, Artificial Sequence
  Synthetic polynucleotide
aggaaactcgaggggctttttttttgtcgagc

SEQ ID NO: 9150 - DNA, 32 bp, Artificial Sequence
  Synthetic polynucleotide
aggaaactcgaggggctccctgtctttttttt

SEQ ID NO: 9151 - DNA, 32 bp, Artificial Sequence
  Synthetic polynucleotide
ttttttttcacttctggagaaagatgcggtgg

SEQ ID NO: 9152 - DNA, 32 bp, Artificial Sequence
  Synthetic polynucleotide
ccagcgacttttttttgagaaagatgcggtgg

SEQ ID NO: 9153 - DNA, 32 bp, Artificial Sequence
  Synthetic polynucleotide
ccagcgaccacttctgtttttttttgcggtgg

SEQ ID NO: 9154 - DNA, 32 bp, Artificial Sequence
  Synthetic polynucleotide
ccagcgaccacttctggagaaagatttttttt

SEQ ID NO: 9155 - DNA, 32 bp, Artificial Sequence
  Synthetic polynucleotide
ttttttttgtgattagcttgggggtgatatac

SEQ ID NO: 9156 - DNA, 32 bp, Artificial Sequence
  Synthetic polynucleotide
cagtagttttttttttcttgggggtgatatac

SEQ ID NO: 9157 - DNA, 32 bp, Artificial Sequence
  Synthetic polynucleotide
cagtagttgtgattagtttttttttgatatac

SEQ ID NO: 9158 - DNA, 32 bp, Artificial Sequence
  Synthetic polynucleotide
cagtagttgtgattagcttgggggtttttttt

SEQ ID NO: 9159 - DNA, 32 bp, Artificial Sequence
  Synthetic polynucleotide
ttttttttactccttctaatgtgactaagcgt

SEQ ID NO: 9160 - DNA, 32 bp, Artificial Sequence
  Synthetic polynucleotide
ctcactaatttttttttaatgtgactaagcgt

SEQ ID NO: 9161 - DNA, 32 bp, Artificial Sequence
  Synthetic polynucleotide
ctcactaaactccttcttttttttctaagcgt

SEQ ID NO: 9162 - DNA, 32 bp, Artificial Sequence
  Synthetic polynucleotide
ctcactaaactccttctaatgtgatttttttt

SEQ ID NO: 9163 - DNA, 32 bp, Artificial Sequence
  Synthetic polynucleotide
ttttttttaaggaaaccagctatcccatattc

SEQ ID NO: 9164 - DNA, 32 bp, Artificial Sequence
  Synthetic polynucleotide
taactccattttttttcagctatcccatattc

SEQ ID NO: 9165 - DNA, 32 bp, Artificial Sequence
  Synthetic polynucleotide
taactccaaaggaaacttttttttccatattc

SEQ ID NO: 9166 - DNA, 32 bp, Artificial Sequence
  Synthetic polynucleotide
taactccaaaggaaaccagctatctttttttt

SEQ ID NO: 9167 - DNA, 32 bp, Artificial Sequence
  Synthetic polynucleotide
ttttttttcggacatctatgcgcccgatatcc

SEQ ID NO: 9168 - DNA, 32 bp, Artificial Sequence
  Synthetic polynucleotide
gatgtaagtttttttttatgcgcccgatatcc

SEQ ID NO: 9169 - DNA, 32 bp, Artificial Sequence
  Synthetic polynucleotide
gatgtaagcggacatcttttttttcgatatcc

SEQ ID NO: 9170 - DNA, 32 bp, Artificial Sequence
  Synthetic polynucleotide
gatgtaagcggacatctatgcgcctttttttt

SEQ ID NO: 9171 - DNA, 32 bp, Artificial Sequence
  Synthetic polynucleotide
tttttttttagggggcttctgaccaaagctca

SEQ ID NO: 9172 - DNA, 32 bp, Artificial Sequence
  Synthetic polynucleotide
gttcaaacttttttttttctgaccaaagctca

SEQ ID NO: 9173 - DNA, 32 bp, Artificial Sequence
  Synthetic polynucleotide
gttcaaactagggggcttttttttaaagctca

SEQ ID NO: 9174 - DNA, 32 bp, Artificial Sequence
  Synthetic polynucleotide
gttcaaactagggggcttctgacctttttttt

SEQ ID NO: 9175 - DNA, 32 bp, Artificial Sequence
  Synthetic polynucleotide
ttttttttgtaaacaggaacagcttagagcag

SEQ ID NO: 9176 - DNA, 32 bp, Artificial Sequence
  Synthetic polynucleotide
tgagaattttttttttgaacagcttagagcag

SEQ ID NO: 9177 - DNA, 32 bp, Artificial Sequence
  Synthetic polynucleotide
tgagaattgtaaacagtttttttttagagcag

SEQ ID NO: 9178 - DNA, 32 bp, Artificial Sequence
  Synthetic polynucleotide
tgagaattgtaaacaggaacagcttttttttt

SEQ ID NO: 9179 - DNA, 32 bp, Artificial Sequence
  Synthetic polynucleotide
ttttttttggatacgctacctatggacgggga

SEQ ID NO: 9180 - DNA, 32 bp, Artificial Sequence
  Synthetic polynucleotide
tcaagttctttttttttacctatggacgggga

SEQ ID NO: 9181 - DNA, 32 bp, Artificial Sequence
  Synthetic polynucleotide
tcaagttcggatacgcttttttttgacgggga

SEQ ID NO: 9182 - DNA, 32 bp, Artificial Sequence
  Synthetic polynucleotide
tcaagttcggatacgctacctatgtttttttt

SEQ ID NO: 9183 - DNA, 32 bp, Artificial Sequence
  Synthetic polynucleotide
ttttttttaccatgatccggatgagttatgaa

SEQ ID NO: 9184 - DNA, 32 bp, Artificial Sequence
  Synthetic polynucleotide
tatgcgacttttttttccggatgagttatgaa

SEQ ID NO: 9185 - DNA, 32 bp, Artificial Sequence
  Synthetic polynucleotide
tatgcgacaccatgatttttttttgttatgaa

SEQ ID NO: 9186 - DNA, 32 bp, Artificial Sequence
  Synthetic polynucleotide
tatgcgacaccatgatccggatgatttttttt

SEQ ID NO: 9187 - DNA, 32 bp, Artificial Sequence
  Synthetic polynucleotide
ttttttttttgggatatacaatctcgaagtaa

SEQ ID NO: 9188 - DNA, 32 bp, Artificial Sequence
  Synthetic polynucleotide
gatcgtcatttttttttacaatctcgaagtaa

SEQ ID NO: 9189 - DNA, 32 bp, Artificial Sequence
  Synthetic polynucleotide
gatcgtcattgggatattttttttcgaagtaa

SEQ ID NO: 9190 - DNA, 32 bp, Artificial Sequence
  Synthetic polynucleotide
gatcgtcattgggatatacaatcttttttttt

SEQ ID NO: 9191 - DNA, 32 bp, Artificial Sequence
  Synthetic polynucleotide
ttttttttaccctgcgaagatagggtcacagc

SEQ ID NO: 9192 - DNA, 32 bp, Artificial Sequence
  Synthetic polynucleotide
agcatagcttttttttaagatagggtcacagc

SEQ ID NO: 9193 - DNA, 32 bp, Artificial Sequence
  Synthetic polynucleotide
agcatagcaccctgcgttttttttgtcacagc

SEQ ID NO: 9194 - DNA, 32 bp, Artificial Sequence
  Synthetic polynucleotide
agcatagcaccctgcgaagataggtttttttt

SEQ ID NO: 9195 - DNA, 32 bp, Artificial Sequence
  Synthetic polynucleotide
ttttttttctctaccttgttggacgtaagcgt

SEQ ID NO: 9196 - DNA, 32 bp, Artificial Sequence
  Synthetic polynucleotide
agtaatactttttttttgttggacgtaagcgt

SEQ ID NO: 9197 - DNA, 32 bp, Artificial Sequence
  Synthetic polynucleotide
agtaatacctctacctttttttttgtaagcgt

SEQ ID NO: 9198 - DNA, 32 bp, Artificial Sequence
  Synthetic polynucleotide
agtaatacctctaccttgttggactttttttt

SEQ ID NO: 9199 - DNA, 32 bp, Artificial Sequence
  Synthetic polynucleotide
ttttttttgaccagaaagcacgaggattatca

SEQ ID NO: 9200 - DNA, 32 bp, Artificial Sequence
  Synthetic polynucleotide
gaaataacttttttttagcacgaggattatca

SEQ ID NO: 9201 - DNA, 32 bp, Artificial Sequence
  Synthetic polynucleotide
gaaataacgaccagaattttttttgattatca

SEQ ID NO: 9202 - DNA, 32 bp, Artificial Sequence
  Synthetic polynucleotide
gaaataacgaccagaaagcacgagtttttttt

SEQ ID NO: 9203 - DNA, 32 bp, Artificial Sequence
  Synthetic polynucleotide
tttttttttcgaaataatcgttagtttctcga

SEQ ID NO: 9204 - DNA, 32 bp, Artificial Sequence
  Synthetic polynucleotide
cgtgtaccttttttttatcgttagtttctcga

SEQ ID NO: 9205 - DNA, 32 bp, Artificial Sequence
  Synthetic polynucleotide
cgtgtacctcgaaatatttttttttttctcga

SEQ ID NO: 9206 - DNA, 32 bp, Artificial Sequence
  Synthetic polynucleotide
cgtgtacctcgaaataatcgttagtttttttt

SEQ ID NO: 9207 - DNA, 32 bp, Artificial Sequence
  Synthetic polynucleotide
ttttttttaaacaggcagcggtagcctcccac

SEQ ID NO: 9208 - DNA, 32 bp, Artificial Sequence
  Synthetic polynucleotide
ctgttccgttttttttagcggtagcctcccac

SEQ ID NO: 9209 - DNA, 32 bp, Artificial Sequence
  Synthetic polynucleotide
ctgttccgaaacaggcttttttttcctcccac

SEQ ID NO: 9210 - DNA, 32 bp, Artificial Sequence
  Synthetic polynucleotide
ctgttccgaaacaggcagcggtagtttttttt

SEQ ID NO: 9211 - DNA, 32 bp, Artificial Sequence
  Synthetic polynucleotide
tttttttttgccttggtaactgattttctcct

SEQ ID NO: 9212 - DNA, 32 bp, Artificial Sequence
  Synthetic polynucleotide
ttaacctatttttttttaactgattttctcct

SEQ ID NO: 9213 - DNA, 32 bp, Artificial Sequence
  Synthetic polynucleotide
ttaacctatgccttggtttttttttttctcct

SEQ ID NO: 9214 - DNA, 32 bp, Artificial Sequence
  Synthetic polynucleotide
ttaacctatgccttggtaactgattttttttt

SEQ ID NO: 9215 - DNA, 32 bp, Artificial Sequence
  Synthetic polynucleotide
tttttttttagctgatctatggtccttaatat

SEQ ID NO: 9216 - DNA, 32 bp, Artificial Sequence
  Synthetic polynucleotide
ggttccgcttttttttctatggtccttaatat

SEQ ID NO: 9217 - DNA, 32 bp, Artificial Sequence
  Synthetic polynucleotide
ggttccgctagctgatttttttttcttaatat

SEQ ID NO: 9218 - DNA, 32 bp, Artificial Sequence
  Synthetic polynucleotide
ggttccgctagctgatctatggtctttttttt

SEQ ID NO: 9219 - DNA, 32 bp, Artificial Sequence
  Synthetic polynucleotide
ttttttttgtgaaacaggccacctggctcggg

SEQ ID NO: 9220 - DNA, 32 bp, Artificial Sequence
  Synthetic polynucleotide
gggagaggttttttttggccacctggctcggg

SEQ ID NO: 9221 - DNA, 32 bp, Artificial Sequence
  Synthetic polynucleotide
gggagagggtgaaacattttttttggctcggg

SEQ ID NO: 9222 - DNA, 32 bp, Artificial Sequence
  Synthetic polynucleotide
gggagagggtgaaacaggccaccttttttttt

SEQ ID NO: 9223 - DNA, 32 bp, Artificial Sequence
  Synthetic polynucleotide
ttttttttggttatactcgtcaagcctgcttt

SEQ ID NO: 9224 - DNA, 32 bp, Artificial Sequence
  Synthetic polynucleotide
gccgcctctttttttttcgtcaagcctgcttt

SEQ ID NO: 9225 - DNA, 32 bp, Artificial Sequence
  Synthetic polynucleotide
gccgcctcggttatacttttttttcctgcttt

SEQ ID NO: 9226 - DNA, 32 bp, Artificial Sequence
  Synthetic polynucleotide
gccgcctcggttatactcgtcaagtttttttt

SEQ ID NO: 9227 - DNA, 32 bp, Artificial Sequence
  Synthetic polynucleotide
ttttttttgtgcccgagcgtctgaggtatggt

SEQ ID NO: 9228 - DNA, 32 bp, Artificial Sequence
  Synthetic polynucleotide
acgtgggattttttttgcgtctgaggtatggt

SEQ ID NO: 9229 - DNA, 32 bp, Artificial Sequence
  Synthetic polynucleotide
acgtgggagtgcccgattttttttggtatggt

SEQ ID NO: 9230 - DNA, 32 bp, Artificial Sequence
  Synthetic polynucleotide
acgtgggagtgcccgagcgtctgatttttttt

SEQ ID NO: 9231 - DNA, 32 bp, Artificial Sequence
  Synthetic polynucleotide
tttttttttatgttgtctcaagtgctaacagt

SEQ ID NO: 9232 - DNA, 32 bp, Artificial Sequence
  Synthetic polynucleotide
ttacccacttttttttctcaagtgctaacagt

SEQ ID NO: 9233 - DNA, 32 bp, Artificial Sequence
  Synthetic polynucleotide
ttacccactatgttgtttttttttctaacagt

SEQ ID NO: 9234 - DNA, 32 bp, Artificial Sequence
  Synthetic polynucleotide
ttacccactatgttgtctcaagtgtttttttt

SEQ ID NO: 9235 - DNA, 32 bp, Artificial Sequence
  Synthetic polynucleotide
tttttttttccataactgtgcacgtcagggat

SEQ ID NO: 9236 - DNA, 32 bp, Artificial Sequence
  Synthetic polynucleotide
actaattatttttttttgtgcacgtcagggat

SEQ ID NO: 9237 - DNA, 32 bp, Artificial Sequence
  Synthetic polynucleotide
actaattatccataactttttttttcagggat

SEQ ID NO: 9238 - DNA, 32 bp, Artificial Sequence
  Synthetic polynucleotide
actaattatccataactgtgcacgtttttttt

SEQ ID NO: 9239 - DNA, 32 bp, Artificial Sequence
  Synthetic polynucleotide
ttttttttgtggccgttgctacatcagtttct

SEQ ID NO: 9240 - DNA, 32 bp, Artificial Sequence
  Synthetic polynucleotide
tctcaccgtttttttttgctacatcagtttct

SEQ ID NO: 9241 - DNA, 32 bp, Artificial Sequence
  Synthetic polynucleotide
tctcaccggtggccgtttttttttcagtttct

SEQ ID NO: 9242 - DNA, 32 bp, Artificial Sequence
  Synthetic polynucleotide
tctcaccggtggccgttgctacattttttttt

SEQ ID NO: 9243 - DNA, 32 bp, Artificial Sequence
  Synthetic polynucleotide
ttttttttctggggaaactatacttacgcact

SEQ ID NO: 9244 - DNA, 32 bp, Artificial Sequence
  Synthetic polynucleotide
ttgcactcttttttttactatacttacgcact

SEQ ID NO: 9245 - DNA, 32 bp, Artificial Sequence
  Synthetic polynucleotide
ttgcactcctggggaatttttttttacgcact

SEQ ID NO: 9246 - DNA, 32 bp, Artificial Sequence
  Synthetic polynucleotide
ttgcactcctggggaaactatacttttttttt

SEQ ID NO: 9247 - DNA, 32 bp, Artificial Sequence
  Synthetic polynucleotide
ttttttttgggattaggcaattgctaggttgc

SEQ ID NO: 9248 - DNA, 32 bp, Artificial Sequence
  Synthetic polynucleotide
ggtttggattttttttgcaattgctaggttgc

SEQ ID NO: 9249 - DNA, 32 bp, Artificial Sequence
  Synthetic polynucleotide
ggtttggagggattagtttttttttaggttgc

SEQ ID NO: 9250 - DNA, 32 bp, Artificial Sequence
  Synthetic polynucleotide
ggtttggagggattaggcaattgctttttttt

SEQ ID NO: 9251 - DNA, 32 bp, Artificial Sequence
  Synthetic polynucleotide
ttttttttcacaatttttgattcgatcacata

SEQ ID NO: 9252 - DNA, 32 bp, Artificial Sequence
  Synthetic polynucleotide
attgtaggttttttttttgattcgatcacata

SEQ ID NO: 9253 - DNA, 32 bp, Artificial Sequence
  Synthetic polynucleotide
attgtaggcacaatttttttttttatcacata

SEQ ID NO: 9254 - DNA, 32 bp, Artificial Sequence
  Synthetic polynucleotide
attgtaggcacaatttttgattcgtttttttt

SEQ ID NO: 9255 - DNA, 32 bp, Artificial Sequence
  Synthetic polynucleotide
ttttttttataaagctgtagcctgaggcgcgc

SEQ ID NO: 9256 - DNA, 32 bp, Artificial Sequence
  Synthetic polynucleotide
catgggcattttttttgtagcctgaggcgcgc

SEQ ID NO: 9257 - DNA, 32 bp, Artificial Sequence
  Synthetic polynucleotide
catgggcaataaagctttttttttaggcgcgc

SEQ ID NO: 9258 - DNA, 32 bp, Artificial Sequence
  Synthetic polynucleotide
catgggcaataaagctgtagcctgtttttttt

SEQ ID NO: 9259 - DNA, 32 bp, Artificial Sequence
  Synthetic polynucleotide
ttttttttcgtgtcaccttgatattgagggac

SEQ ID NO: 9260 - DNA, 32 bp, Artificial Sequence
  Synthetic polynucleotide
agctgcacttttttttcttgatattgagggac

SEQ ID NO: 9261 - DNA, 32 bp, Artificial Sequence
  Synthetic polynucleotide
agctgcaccgtgtcactttttttttgagggac

SEQ ID NO: 9262 - DNA, 32 bp, Artificial Sequence
  Synthetic polynucleotide
agctgcaccgtgtcaccttgatattttttttt

SEQ ID NO: 9263 - DNA, 32 bp, Artificial Sequence
  Synthetic polynucleotide
ttttttttattcggataaaccatactgagggc

SEQ ID NO: 9264 - DNA, 32 bp, Artificial Sequence
  Synthetic polynucleotide
acctcgtcttttttttaaaccatactgagggc

SEQ ID NO: 9265 - DNA, 32 bp, Artificial Sequence
  Synthetic polynucleotide
acctcgtcattcggatttttttttctgagggc

SEQ ID NO: 9266 - DNA, 32 bp, Artificial Sequence
  Synthetic polynucleotide
acctcgtcattcggataaaccatatttttttt

SEQ ID NO: 9267 - DNA, 32 bp, Artificial Sequence
  Synthetic polynucleotide
ttttttttagatcggctaatcattagtgctcc

SEQ ID NO: 9268 - DNA, 32 bp, Artificial Sequence
  Synthetic polynucleotide
agtgggcgtttttttttaatcattagtgctcc

SEQ ID NO: 9269 - DNA, 32 bp, Artificial Sequence
  Synthetic polynucleotide
agtgggcgagatcggcttttttttagtgctcc

SEQ ID NO: 9270 - DNA, 32 bp, Artificial Sequence
  Synthetic polynucleotide
agtgggcgagatcggctaatcatttttttttt

SEQ ID NO: 9271 - DNA, 32 bp, Artificial Sequence
  Synthetic polynucleotide
ttttttttgttcatagttcattaggggcggaa

SEQ ID NO: 9272 - DNA, 32 bp, Artificial Sequence
  Synthetic polynucleotide
cttagttattttttttttcattaggggcggaa

SEQ ID NO: 9273 - DNA, 32 bp, Artificial Sequence
  Synthetic polynucleotide
cttagttagttcatagttttttttgggcggaa

SEQ ID NO: 9274 - DNA, 32 bp, Artificial Sequence
  Synthetic polynucleotide
cttagttagttcatagttcattagtttttttt

SEQ ID NO: 9275 - DNA, 32 bp, Artificial Sequence
  Synthetic polynucleotide
ttttttttgtgccccacgtacagtaaccaacc

SEQ ID NO: 9276 - DNA, 32 bp, Artificial Sequence
  Synthetic polynucleotide
atgggctgttttttttcgtacagtaaccaacc

SEQ ID NO: 9277 - DNA, 32 bp, Artificial Sequence
  Synthetic polynucleotide
atgggctggtgccccattttttttaaccaacc

SEQ ID NO: 9278 - DNA, 32 bp, Artificial Sequence
  Synthetic polynucleotide
atgggctggtgccccacgtacagttttttttt

SEQ ID NO: 9279 - DNA, 32 bp, Artificial Sequence
  Synthetic polynucleotide
tttttttttgtgggtagggccgagcgctgggc

SEQ ID NO: 9280 - DNA, 32 bp, Artificial Sequence
  Synthetic polynucleotide
ggtgtaccttttttttgggccgagcgctgggc

SEQ ID NO: 9281 - DNA, 32 bp, Artificial Sequence
  Synthetic polynucleotide
ggtgtacctgtgggtattttttttcgctgggc

SEQ ID NO: 9282 - DNA, 32 bp, Artificial Sequence
  Synthetic polynucleotide
ggtgtacctgtgggtagggccgagtttttttt

SEQ ID NO: 9283 - DNA, 32 bp, Artificial Sequence
  Synthetic polynucleotide
ttttttttgcaagtgaaatatatgacttggtc

SEQ ID NO: 9284 - DNA, 32 bp, Artificial Sequence
  Synthetic polynucleotide
ttacatgtttttttttaatatatgacttggtc

SEQ ID NO: 9285 - DNA, 32 bp, Artificial Sequence
  Synthetic polynucleotide
ttacatgtgcaagtgattttttttacttggtc

SEQ ID NO: 9286 - DNA, 32 bp, Artificial Sequence
  Synthetic polynucleotide
ttacatgtgcaagtgaaatatatgtttttttt

SEQ ID NO: 9287 - DNA, 32 bp, Artificial Sequence
  Synthetic polynucleotide
ttttttttctgctagaaaccaccaacatcctc

SEQ ID NO: 9288 - DNA, 32 bp, Artificial Sequence
  Synthetic polynucleotide
gaccagatttttttttaaccaccaacatcctc

SEQ ID NO: 9289 - DNA, 32 bp, Artificial Sequence
  Synthetic polynucleotide
gaccagatctgctagattttttttacatcctc

SEQ ID NO: 9290 - DNA, 32 bp, Artificial Sequence
  Synthetic polynucleotide
gaccagatctgctagaaaccaccatttttttt

SEQ ID NO: 9291 - DNA, 32 bp, Artificial Sequence
  Synthetic polynucleotide
ttttttttctttcaatttttagtaaacaccca

SEQ ID NO: 9292 - DNA, 32 bp, Artificial Sequence
  Synthetic polynucleotide
cttgacacttttttttttttagtaaacaccca

SEQ ID NO: 9293 - DNA, 32 bp, Artificial Sequence
  Synthetic polynucleotide
cttgacacctttcaatttttttttaacaccca

SEQ ID NO: 9294 - DNA, 32 bp, Artificial Sequence
  Synthetic polynucleotide
cttgacacctttcaatttttagtatttttttt

SEQ ID NO: 9295 - DNA, 32 bp, Artificial Sequence
  Synthetic polynucleotide
ttttttttgaacttcccatggtcgttctactg

SEQ ID NO: 9296 - DNA, 32 bp, Artificial Sequence
  Synthetic polynucleotide
acagagctttttttttcatggtcgttctactg

SEQ ID NO: 9297 - DNA, 32 bp, Artificial Sequence
  Synthetic polynucleotide
acagagctgaacttccttttttttttctactg

SEQ ID NO: 9298 - DNA, 32 bp, Artificial Sequence
  Synthetic polynucleotide
acagagctgaacttcccatggtcgtttttttt

SEQ ID NO: 9299 - DNA, 32 bp, Artificial Sequence
  Synthetic polynucleotide
tttttttttcataggatcaaactaaatacagc

SEQ ID NO: 9300 - DNA, 32 bp, Artificial Sequence
  Synthetic polynucleotide
tcgtatgatttttttttcaaactaaatacagc

SEQ ID NO: 9301 - DNA, 32 bp, Artificial Sequence
  Synthetic polynucleotide
tcgtatgatcataggattttttttaatacagc

SEQ ID NO: 9302 - DNA, 32 bp, Artificial Sequence
  Synthetic polynucleotide
tcgtatgatcataggatcaaactatttttttt

SEQ ID NO: 9303 - DNA, 32 bp, Artificial Sequence
  Synthetic polynucleotide
ttttttttagttcttgtccttattggcgatcg

SEQ ID NO: 9304 - DNA, 32 bp, Artificial Sequence
  Synthetic polynucleotide
gtaccgcctttttttttccttattggcgatcg

SEQ ID NO: 9305 - DNA, 32 bp, Artificial Sequence
  Synthetic polynucleotide
gtaccgccagttcttgttttttttggcgatcg

SEQ ID NO: 9306 - DNA, 32 bp, Artificial Sequence
  Synthetic polynucleotide
gtaccgccagttcttgtccttatttttttttt

SEQ ID NO: 9307 - DNA, 32 bp, Artificial Sequence
  Synthetic polynucleotide
ttttttttaatgtttgatggccgcgtggctta

SEQ ID NO: 9308 - DNA, 32 bp, Artificial Sequence
  Synthetic polynucleotide
tgcattccttttttttatggccgcgtggctta

SEQ ID NO: 9309 - DNA, 32 bp, Artificial Sequence
  Synthetic polynucleotide
tgcattccaatgtttgttttttttgtggctta

SEQ ID NO: 9310 - DNA, 32 bp, Artificial Sequence
  Synthetic polynucleotide
tgcattccaatgtttgatggccgctttttttt

SEQ ID NO: 9311 - DNA, 32 bp, Artificial Sequence
  Synthetic polynucleotide
ttttttttaaagtcgtccgcctccggtagtca

SEQ ID NO: 9312 - DNA, 32 bp, Artificial Sequence
  Synthetic polynucleotide
aaccacatttttttttccgcctccggtagtca

SEQ ID NO: 9313 - DNA, 32 bp, Artificial Sequence
  Synthetic polynucleotide
aaccacataaagtcgtttttttttggtagtca

SEQ ID NO: 9314 - DNA, 32 bp, Artificial Sequence
  Synthetic polynucleotide
aaccacataaagtcgtccgcctcctttttttt

SEQ ID NO: 9315 - DNA, 32 bp, Artificial Sequence
  Synthetic polynucleotide
ttttttttctatacccgacaaaaacagatttg

SEQ ID NO: 9316 - DNA, 32 bp, Artificial Sequence
  Synthetic polynucleotide
cagaaagtttttttttgacaaaaacagatttg

SEQ ID NO: 9317 - DNA, 32 bp, Artificial Sequence
  Synthetic polynucleotide
cagaaagtctatacccttttttttcagatttg

SEQ ID NO: 9318 - DNA, 32 bp, Artificial Sequence
  Synthetic polynucleotide
cagaaagtctatacccgacaaaaatttttttt

SEQ ID NO: 9319 - DNA, 32 bp, Artificial Sequence
  Synthetic polynucleotide
tttttttttgcgggggggtcgagcgctccact

SEQ ID NO: 9320 - DNA, 32 bp, Artificial Sequence
  Synthetic polynucleotide
tatactctttttttttggtcgagcgctccact

SEQ ID NO: 9321 - DNA, 32 bp, Artificial Sequence
  Synthetic polynucleotide
tatactcttgcgggggttttttttgctccact

SEQ ID NO: 9322 - DNA, 32 bp, Artificial Sequence
  Synthetic polynucleotide
tatactcttgcgggggggtcgagctttttttt

SEQ ID NO: 9323 - DNA, 32 bp, Artificial Sequence
  Synthetic polynucleotide
ttttttttcggccatcgtggactagaaagcgc

SEQ ID NO: 9324 - DNA, 32 bp, Artificial Sequence
  Synthetic polynucleotide
gtagtggcttttttttgtggactagaaagcgc

SEQ ID NO: 9325 - DNA, 32 bp, Artificial Sequence
  Synthetic polynucleotide
gtagtggccggccatcttttttttgaaagcgc

SEQ ID NO: 9326 - DNA, 32 bp, Artificial Sequence
  Synthetic polynucleotide
gtagtggccggccatcgtggactatttttttt

SEQ ID NO: 9327 - DNA, 32 bp, Artificial Sequence
  Synthetic polynucleotide
tttttttttgaatatcgctacctccgatacgc

SEQ ID NO: 9328 - DNA, 32 bp, Artificial Sequence
  Synthetic polynucleotide
cggcaatcttttttttgctacctccgatacgc

SEQ ID NO: 9329 - DNA, 32 bp, Artificial Sequence
  Synthetic polynucleotide
cggcaatctgaatatcttttttttcgatacgc

SEQ ID NO: 9330 - DNA, 32 bp, Artificial Sequence
  Synthetic polynucleotide
cggcaatctgaatatcgctacctctttttttt

SEQ ID NO: 9331 - DNA, 32 bp, Artificial Sequence
  Synthetic polynucleotide
ttttttttaccatttaagagtaggggcagtgc

SEQ ID NO: 9332 - DNA, 32 bp, Artificial Sequence
  Synthetic polynucleotide
gaaccagattttttttagagtaggggcagtgc

SEQ ID NO: 9333 - DNA, 32 bp, Artificial Sequence
  Synthetic polynucleotide
gaaccagaaccatttattttttttggcagtgc

SEQ ID NO: 9334 - DNA, 32 bp, Artificial Sequence
  Synthetic polynucleotide
gaaccagaaccatttaagagtaggtttttttt

SEQ ID NO: 9335 - DNA, 32 bp, Artificial Sequence
  Synthetic polynucleotide
ttttttttacagtgggacatctcggaaaggtg

SEQ ID NO: 9336 - DNA, 32 bp, Artificial Sequence
  Synthetic polynucleotide
tcagccaattttttttacatctcggaaaggtg

SEQ ID NO: 9337 - DNA, 32 bp, Artificial Sequence
  Synthetic polynucleotide
tcagccaaacagtgggttttttttgaaaggtg

SEQ ID NO: 9338 - DNA, 32 bp, Artificial Sequence
  Synthetic polynucleotide
tcagccaaacagtgggacatctcgtttttttt

SEQ ID NO: 9339 - DNA, 32 bp, Artificial Sequence
  Synthetic polynucleotide
ttttttttgcaagtaaaaaaggaattatgaga

SEQ ID NO: 9340 - DNA, 32 bp, Artificial Sequence
  Synthetic polynucleotide
tcccaagtttttttttaaaaggaattatgaga

SEQ ID NO: 9341 - DNA, 32 bp, Artificial Sequence
  Synthetic polynucleotide
tcccaagtgcaagtaattttttttttatgaga

SEQ ID NO: 9342 - DNA, 32 bp, Artificial Sequence
  Synthetic polynucleotide
tcccaagtgcaagtaaaaaaggaatttttttt

SEQ ID NO: 9343 - DNA, 32 bp, Artificial Sequence
  Synthetic polynucleotide
ttttttttgatcctaaagtttctggtagacct

SEQ ID NO: 9344 - DNA, 32 bp, Artificial Sequence
  Synthetic polynucleotide
tcatgtggttttttttagtttctggtagacct

SEQ ID NO: 9345 - DNA, 32 bp, Artificial Sequence
  Synthetic polynucleotide
tcatgtgggatcctaattttttttgtagacct

SEQ ID NO: 9346 - DNA, 32 bp, Artificial Sequence
  Synthetic polynucleotide
tcatgtgggatcctaaagtttctgtttttttt

SEQ ID NO: 9347 - DNA, 32 bp, Artificial Sequence
  Synthetic polynucleotide
ttttttttagagcggtgatatccacggtacat

SEQ ID NO: 9348 - DNA, 32 bp, Artificial Sequence
  Synthetic polynucleotide
cgtaggctttttttttgatatccacggtacat

SEQ ID NO: 9349 - DNA, 32 bp, Artificial Sequence
  Synthetic polynucleotide
cgtaggctagagcggtttttttttcggtacat

SEQ ID NO: 9350 - DNA, 32 bp, Artificial Sequence
  Synthetic polynucleotide
cgtaggctagagcggtgatatccatttttttt

SEQ ID NO: 9351 - DNA, 32 bp, Artificial Sequence
  Synthetic polynucleotide
tttttttttgcacggaacgagagtgctggcat

SEQ ID NO: 9352 - DNA, 32 bp, Artificial Sequence
  Synthetic polynucleotide
tcgtttacttttttttacgagagtgctggcat

SEQ ID NO: 9353 - DNA, 32 bp, Artificial Sequence
  Synthetic polynucleotide
tcgtttactgcacggattttttttgctggcat

SEQ ID NO: 9354 - DNA, 32 bp, Artificial Sequence
  Synthetic polynucleotide
tcgtttactgcacggaacgagagttttttttt

SEQ ID NO: 9355 - DNA, 32 bp, Artificial Sequence
  Synthetic polynucleotide
ttttttttgaaacctaacttggggactaagat

SEQ ID NO: 9356 - DNA, 32 bp, Artificial Sequence
  Synthetic polynucleotide
aagcaagattttttttacttggggactaagat

SEQ ID NO: 9357 - DNA, 32 bp, Artificial Sequence
  Synthetic polynucleotide
aagcaagagaaacctattttttttactaagat

SEQ ID NO: 9358 - DNA, 32 bp, Artificial Sequence
  Synthetic polynucleotide
aagcaagagaaacctaacttggggtttttttt

SEQ ID NO: 9359 - DNA, 32 bp, Artificial Sequence
  Synthetic polynucleotide
ttttttttattttcgcgcgattcgcatgtagc

SEQ ID NO: 9360 - DNA, 32 bp, Artificial Sequence
  Synthetic polynucleotide
cgttgcgattttttttgcgattcgcatgtagc

SEQ ID NO: 9361 - DNA, 32 bp, Artificial Sequence
  Synthetic polynucleotide
cgttgcgaattttcgcttttttttcatgtagc

SEQ ID NO: 9362 - DNA, 32 bp, Artificial Sequence
  Synthetic polynucleotide
cgttgcgaattttcgcgcgattcgtttttttt

SEQ ID NO: 9363 - DNA, 32 bp, Artificial Sequence
  Synthetic polynucleotide
ttttttttatcgtcctagacgacggatctcct

SEQ ID NO: 9364 - DNA, 32 bp, Artificial Sequence
  Synthetic polynucleotide
cgaacgagttttttttagacgacggatctcct

SEQ ID NO: 9365 - DNA, 32 bp, Artificial Sequence
  Synthetic polynucleotide
cgaacgagatcgtcctttttttttgatctcct

SEQ ID NO: 9366 - DNA, 32 bp, Artificial Sequence
  Synthetic polynucleotide
cgaacgagatcgtcctagacgacgtttttttt

SEQ ID NO: 9367 - DNA, 32 bp, Artificial Sequence
  Synthetic polynucleotide
ttttttttgtagcaccgtcaaatatgcgtgct

SEQ ID NO: 9368 - DNA, 32 bp, Artificial Sequence
  Synthetic polynucleotide
gcatgccgttttttttgtcaaatatgcgtgct

SEQ ID NO: 9369 - DNA, 32 bp, Artificial Sequence
  Synthetic polynucleotide
gcatgccggtagcacctttttttttgcgtgct

SEQ ID NO: 9370 - DNA, 32 bp, Artificial Sequence
  Synthetic polynucleotide
gcatgccggtagcaccgtcaaatatttttttt

SEQ ID NO: 9371 - DNA, 32 bp, Artificial Sequence
  Synthetic polynucleotide
tttttttttttagacccagcttgacgcaagac

SEQ ID NO: 9372 - DNA, 32 bp, Artificial Sequence
  Synthetic polynucleotide
tttaacgcttttttttcagcttgacgcaagac

SEQ ID NO: 9373 - DNA, 32 bp, Artificial Sequence
  Synthetic polynucleotide
tttaacgctttagaccttttttttcgcaagac

SEQ ID NO: 9374 - DNA, 32 bp, Artificial Sequence
  Synthetic polynucleotide
tttaacgctttagacccagcttgatttttttt

SEQ ID NO: 9375 - DNA, 32 bp, Artificial Sequence
  Synthetic polynucleotide
ttttttttctgggcagggtcctaggttgcaga

SEQ ID NO: 9376 - DNA, 32 bp, Artificial Sequence
  Synthetic polynucleotide
gctaatcattttttttggtcctaggttgcaga

SEQ ID NO: 9377 - DNA, 32 bp, Artificial Sequence
  Synthetic polynucleotide
gctaatcactgggcagttttttttgttgcaga

SEQ ID NO: 9378 - DNA, 32 bp, Artificial Sequence
  Synthetic polynucleotide
gctaatcactgggcagggtcctagtttttttt

SEQ ID NO: 9379 - DNA, 32 bp, Artificial Sequence
  Synthetic polynucleotide
ttttttttccctaagcagcgtagtaagggtta

SEQ ID NO: 9380 - DNA, 32 bp, Artificial Sequence
  Synthetic polynucleotide
aacctaccttttttttagcgtagtaagggtta

SEQ ID NO: 9381 - DNA, 32 bp, Artificial Sequence
  Synthetic polynucleotide
aacctaccccctaagcttttttttaagggtta

SEQ ID NO: 9382 - DNA, 32 bp, Artificial Sequence
  Synthetic polynucleotide
aacctaccccctaagcagcgtagttttttttt

SEQ ID NO: 9383 - DNA, 32 bp, Artificial Sequence
  Synthetic polynucleotide
tttttttttgcggcggctgtacgaatgagtcc

SEQ ID NO: 9384 - DNA, 32 bp, Artificial Sequence
  Synthetic polynucleotide
caagttccttttttttctgtacgaatgagtcc

SEQ ID NO: 9385 - DNA, 32 bp, Artificial Sequence
  Synthetic polynucleotide
caagttcctgcggcggttttttttatgagtcc

SEQ ID NO: 9386 - DNA, 32 bp, Artificial Sequence
  Synthetic polynucleotide
caagttcctgcggcggctgtacgatttttttt

SEQ ID NO: 9387 - DNA, 32 bp, Artificial Sequence
  Synthetic polynucleotide
ttttttttcatgacattctcccacccgtccaa

SEQ ID NO: 9388 - DNA, 32 bp, Artificial Sequence
  Synthetic polynucleotide
ggccttgatttttttttctcccacccgtccaa

SEQ ID NO: 9389 - DNA, 32 bp, Artificial Sequence
  Synthetic polynucleotide
ggccttgacatgacatttttttttccgtccaa

SEQ ID NO: 9390 - DNA, 32 bp, Artificial Sequence
  Synthetic polynucleotide
ggccttgacatgacattctcccactttttttt

SEQ ID NO: 9391 - DNA, 32 bp, Artificial Sequence
  Synthetic polynucleotide
ttttttttggatgtcgagcccacaacttgaca

SEQ ID NO: 9392 - DNA, 32 bp, Artificial Sequence
  Synthetic polynucleotide
caccagcattttttttagcccacaacttgaca

SEQ ID NO: 9393 - DNA, 32 bp, Artificial Sequence
  Synthetic polynucleotide
caccagcaggatgtcgttttttttacttgaca

SEQ ID NO: 9394 - DNA, 32 bp, Artificial Sequence
  Synthetic polynucleotide
caccagcaggatgtcgagcccacatttttttt

SEQ ID NO: 9395 - DNA, 32 bp, Artificial Sequence
  Synthetic polynucleotide
ttttttttgtatcttttttcatggcggcgatg

SEQ ID NO: 9396 - DNA, 32 bp, Artificial Sequence
  Synthetic polynucleotide
gtagtacatttttttttttcatggcggcgatg

SEQ ID NO: 9397 - DNA, 32 bp, Artificial Sequence
  Synthetic polynucleotide
gtagtacagtatctttttttttttcggcgatg

SEQ ID NO: 9398 - DNA, 32 bp, Artificial Sequence
  Synthetic polynucleotide
gtagtacagtatcttttttcatggtttttttt

SEQ ID NO: 9399 - DNA, 32 bp, Artificial Sequence
  Synthetic polynucleotide
ttttttttgcttttatatagcgtagaccggac

SEQ ID NO: 9400 - DNA, 32 bp, Artificial Sequence
  Synthetic polynucleotide
tgcgtacgttttttttatagcgtagaccggac

SEQ ID NO: 9401 - DNA, 32 bp, Artificial Sequence
  Synthetic polynucleotide
tgcgtacggcttttatttttttttgaccggac

SEQ ID NO: 9402 - DNA, 32 bp, Artificial Sequence
  Synthetic polynucleotide
tgcgtacggcttttatatagcgtatttttttt

SEQ ID NO: 9403 - DNA, 32 bp, Artificial Sequence
  Synthetic polynucleotide
tttttttttatgccccccggttctgctagagt

SEQ ID NO: 9404 - DNA, 32 bp, Artificial Sequence
  Synthetic polynucleotide
agagtcgtttttttttccggttctgctagagt

SEQ ID NO: 9405 - DNA, 32 bp, Artificial Sequence
  Synthetic polynucleotide
agagtcgttatgccccttttttttgctagagt

SEQ ID NO: 9406 - DNA, 32 bp, Artificial Sequence
  Synthetic polynucleotide
agagtcgttatgccccccggttcttttttttt

SEQ ID NO: 9407 - DNA, 32 bp, Artificial Sequence
  Synthetic polynucleotide
ttttttttccaagtaacgtatgtacgacgcga

SEQ ID NO: 9408 - DNA, 32 bp, Artificial Sequence
  Synthetic polynucleotide
cgcgcttattttttttcgtatgtacgacgcga

SEQ ID NO: 9409 - DNA, 32 bp, Artificial Sequence
  Synthetic polynucleotide
cgcgcttaccaagtaattttttttcgacgcga

SEQ ID NO: 9410 - DNA, 32 bp, Artificial Sequence
  Synthetic polynucleotide
cgcgcttaccaagtaacgtatgtatttttttt

SEQ ID NO: 9411 - DNA, 32 bp, Artificial Sequence
  Synthetic polynucleotide
ttttttttaacgggtggatgaatttcgttcgg

SEQ ID NO: 9412 - DNA, 32 bp, Artificial Sequence
  Synthetic polynucleotide
tgcgagtgttttttttgatgaatttcgttcgg

SEQ ID NO: 9413 - DNA, 32 bp, Artificial Sequence
  Synthetic polynucleotide
tgcgagtgaacgggtgtttttttttcgttcgg

SEQ ID NO: 9414 - DNA, 32 bp, Artificial Sequence
  Synthetic polynucleotide
tgcgagtgaacgggtggatgaatttttttttt

SEQ ID NO: 9415 - DNA, 32 bp, Artificial Sequence
  Synthetic polynucleotide
ttttttttgatctaagtctggcgcgtgaggac

SEQ ID NO: 9416 - DNA, 32 bp, Artificial Sequence
  Synthetic polynucleotide
ggccaggctttttttttctggcgcgtgaggac

SEQ ID NO: 9417 - DNA, 32 bp, Artificial Sequence
  Synthetic polynucleotide
ggccaggcgatctaagttttttttgtgaggac

SEQ ID NO: 9418 - DNA, 32 bp, Artificial Sequence
  Synthetic polynucleotide
ggccaggcgatctaagtctggcgctttttttt

SEQ ID NO: 9419 - DNA, 32 bp, Artificial Sequence
  Synthetic polynucleotide
tttttttttgaagtaggaagctttttctagcc

SEQ ID NO: 9420 - DNA, 32 bp, Artificial Sequence
  Synthetic polynucleotide
acgtaagtttttttttgaagctttttctagcc

SEQ ID NO: 9421 - DNA, 32 bp, Artificial Sequence
  Synthetic polynucleotide
acgtaagttgaagtagttttttttttctagcc

SEQ ID NO: 9422 - DNA, 32 bp, Artificial Sequence
  Synthetic polynucleotide
acgtaagttgaagtaggaagcttttttttttt

SEQ ID NO: 9423 - DNA, 32 bp, Artificial Sequence
  Synthetic polynucleotide
ttttttttgacactacgacctgcttttcgaca

SEQ ID NO: 9424 - DNA, 32 bp, Artificial Sequence
  Synthetic polynucleotide
atagcatcttttttttgacctgcttttcgaca

SEQ ID NO: 9425 - DNA, 32 bp, Artificial Sequence
  Synthetic polynucleotide
atagcatcgacactactttttttttttcgaca

SEQ ID NO: 9426 - DNA, 32 bp, Artificial Sequence
  Synthetic polynucleotide
atagcatcgacactacgacctgcttttttttt

SEQ ID NO: 9427 - DNA, 32 bp, Artificial Sequence
  Synthetic polynucleotide
ttttttttattctggacagtaactgcattaac

SEQ ID NO: 9428 - DNA, 32 bp, Artificial Sequence
  Synthetic polynucleotide
cggactgcttttttttcagtaactgcattaac

SEQ ID NO: 9429 - DNA, 32 bp, Artificial Sequence
  Synthetic polynucleotide
cggactgcattctggattttttttgcattaac

SEQ ID NO: 9430 - DNA, 32 bp, Artificial Sequence
  Synthetic polynucleotide
cggactgcattctggacagtaacttttttttt

SEQ ID NO: 9431 - DNA, 32 bp, Artificial Sequence
  Synthetic polynucleotide
ttttttttcccaacataagtgacgtcctcagc

SEQ ID NO: 9432 - DNA, 32 bp, Artificial Sequence
  Synthetic polynucleotide
tacgtgctttttttttaagtgacgtcctcagc

SEQ ID NO: 9433 - DNA, 32 bp, Artificial Sequence
  Synthetic polynucleotide
tacgtgctcccaacattttttttttcctcagc

SEQ ID NO: 9434 - DNA, 32 bp, Artificial Sequence
  Synthetic polynucleotide
tacgtgctcccaacataagtgacgtttttttt

SEQ ID NO: 9435 - DNA, 32 bp, Artificial Sequence
  Synthetic polynucleotide
ttttttttattatctcgataagcagaaggacc

SEQ ID NO: 9436 - DNA, 32 bp, Artificial Sequence
  Synthetic polynucleotide
agttgaaattttttttgataagcagaaggacc

SEQ ID NO: 9437 - DNA, 32 bp, Artificial Sequence
  Synthetic polynucleotide
agttgaaaattatctcttttttttgaaggacc

SEQ ID NO: 9438 - DNA, 32 bp, Artificial Sequence
  Synthetic polynucleotide
agttgaaaattatctcgataagcatttttttt

SEQ ID NO: 9439 - DNA, 32 bp, Artificial Sequence
  Synthetic polynucleotide
tttttttttggcaagagacaaggccgcttcag

SEQ ID NO: 9440 - DNA, 32 bp, Artificial Sequence
  Synthetic polynucleotide
tgtataacttttttttgacaaggccgcttcag

SEQ ID NO: 9441 - DNA, 32 bp, Artificial Sequence
  Synthetic polynucleotide
tgtataactggcaagattttttttcgcttcag

SEQ ID NO: 9442 - DNA, 32 bp, Artificial Sequence
  Synthetic polynucleotide
tgtataactggcaagagacaaggctttttttt

SEQ ID NO: 9443 - DNA, 32 bp, Artificial Sequence
  Synthetic polynucleotide
ttttttttgccggaccgtattaatgccgcgcc

SEQ ID NO: 9444 - DNA, 32 bp, Artificial Sequence
  Synthetic polynucleotide
aaaggatattttttttgtattaatgccgcgcc

SEQ ID NO: 9445 - DNA, 32 bp, Artificial Sequence
  Synthetic polynucleotide
aaaggatagccggaccttttttttgccgcgcc

SEQ ID NO: 9446 - DNA, 32 bp, Artificial Sequence
  Synthetic polynucleotide
aaaggatagccggaccgtattaattttttttt

SEQ ID NO: 9447 - DNA, 32 bp, Artificial Sequence
  Synthetic polynucleotide
ttttttttcccggacctagtgtctatcaagtc

SEQ ID NO: 9448 - DNA, 32 bp, Artificial Sequence
  Synthetic polynucleotide
aacggttttttttttttagtgtctatcaagtc

SEQ ID NO: 9449 - DNA, 32 bp, Artificial Sequence
  Synthetic polynucleotide
aacggtttcccggaccttttttttatcaagtc

SEQ ID NO: 9450 - DNA, 32 bp, Artificial Sequence
  Synthetic polynucleotide
aacggtttcccggacctagtgtcttttttttt

SEQ ID NO: 9451 - DNA, 32 bp, Artificial Sequence
  Synthetic polynucleotide
ttttttttgaaaccattctcgggtcgagcggg

SEQ ID NO: 9452 - DNA, 32 bp, Artificial Sequence
  Synthetic polynucleotide
tattctattttttttttctcgggtcgagcggg

SEQ ID NO: 9453 - DNA, 32 bp, Artificial Sequence
  Synthetic polynucleotide
tattctatgaaaccatttttttttcgagcggg

SEQ ID NO: 9454 - DNA, 32 bp, Artificial Sequence
  Synthetic polynucleotide
tattctatgaaaccattctcgggttttttttt

SEQ ID NO: 9455 - DNA, 32 bp, Artificial Sequence
  Synthetic polynucleotide
ttttttttgtgacctacgagaagcgtatagat

SEQ ID NO: 9456 - DNA, 32 bp, Artificial Sequence
  Synthetic polynucleotide
tcactgttttttttttcgagaagcgtatagat

SEQ ID NO: 9457 - DNA, 32 bp, Artificial Sequence
  Synthetic polynucleotide
tcactgttgtgacctattttttttgtatagat

SEQ ID NO: 9458 - DNA, 32 bp, Artificial Sequence
  Synthetic polynucleotide
tcactgttgtgacctacgagaagctttttttt

SEQ ID NO: 9459 - DNA, 32 bp, Artificial Sequence
  Synthetic polynucleotide
ttttttttcgaatagctcacaggcgaactacg

SEQ ID NO: 9460 - DNA, 32 bp, Artificial Sequence
  Synthetic polynucleotide
gttccgcgtttttttttcacaggcgaactacg

SEQ ID NO: 9461 - DNA, 32 bp, Artificial Sequence
  Synthetic polynucleotide
gttccgcgcgaatagcttttttttgaactacg

SEQ ID NO: 9462 - DNA, 32 bp, Artificial Sequence
  Synthetic polynucleotide
gttccgcgcgaatagctcacaggctttttttt

SEQ ID NO: 9463 - DNA, 32 bp, Artificial Sequence
  Synthetic polynucleotide
ttttttttggtttaaacgctcctcgggaatta

SEQ ID NO: 9464 - DNA, 32 bp, Artificial Sequence
  Synthetic polynucleotide
tatgaattttttttttcgctcctcgggaatta

SEQ ID NO: 9465 - DNA, 32 bp, Artificial Sequence
  Synthetic polynucleotide
tatgaattggtttaaattttttttgggaatta

SEQ ID NO: 9466 - DNA, 32 bp, Artificial Sequence
  Synthetic polynucleotide
tatgaattggtttaaacgctcctctttttttt

SEQ ID NO: 9467 - DNA, 32 bp, Artificial Sequence
  Synthetic polynucleotide
ttttttttggtggcaaaccacctccgatgtca

SEQ ID NO: 9468 - DNA, 32 bp, Artificial Sequence
  Synthetic polynucleotide
atacgacattttttttaccacctccgatgtca

SEQ ID NO: 9469 - DNA, 32 bp, Artificial Sequence
  Synthetic polynucleotide
atacgacaggtggcaattttttttcgatgtca

SEQ ID NO: 9470 - DNA, 32 bp, Artificial Sequence
  Synthetic polynucleotide
atacgacaggtggcaaaccacctctttttttt

SEQ ID NO: 9471 - DNA, 32 bp, Artificial Sequence
  Synthetic polynucleotide
tttttttttacccattcactgtgaatttccac

SEQ ID NO: 9472 - DNA, 32 bp, Artificial Sequence
  Synthetic polynucleotide
gcgccgcattttttttcactgtgaatttccac

SEQ ID NO: 9473 - DNA, 32 bp, Artificial Sequence
  Synthetic polynucleotide
gcgccgcatacccattttttttttatttccac

SEQ ID NO: 9474 - DNA, 32 bp, Artificial Sequence
  Synthetic polynucleotide
gcgccgcatacccattcactgtgatttttttt

SEQ ID NO: 9475 - DNA, 32 bp, Artificial Sequence
  Synthetic polynucleotide
ttttttttttcgcaggtccatgggattcacca

SEQ ID NO: 9476 - DNA, 32 bp, Artificial Sequence
  Synthetic polynucleotide
accgaggatttttttttccatgggattcacca

SEQ ID NO: 9477 - DNA, 32 bp, Artificial Sequence
  Synthetic polynucleotide
accgaggattcgcaggttttttttattcacca

SEQ ID NO: 9478 - DNA, 32 bp, Artificial Sequence
  Synthetic polynucleotide
accgaggattcgcaggtccatgggtttttttt

SEQ ID NO: 9479 - DNA, 32 bp, Artificial Sequence
  Synthetic polynucleotide
tttttttttacaccctgattctccatggcagc

SEQ ID NO: 9480 - DNA, 32 bp, Artificial Sequence
  Synthetic polynucleotide
agctcgtattttttttgattctccatggcagc

SEQ ID NO: 9481 - DNA, 32 bp, Artificial Sequence
  Synthetic polynucleotide
agctcgtatacaccctttttttttatggcagc

SEQ ID NO: 9482 - DNA, 32 bp, Artificial Sequence
  Synthetic polynucleotide
agctcgtatacaccctgattctcctttttttt

SEQ ID NO: 9483 - DNA, 32 bp, Artificial Sequence
  Synthetic polynucleotide
ttttttttacaggtctgaactggtagatcacc

SEQ ID NO: 9484 - DNA, 32 bp, Artificial Sequence
  Synthetic polynucleotide
gcttcggtttttttttgaactggtagatcacc

SEQ ID NO: 9485 - DNA, 32 bp, Artificial Sequence
  Synthetic polynucleotide
gcttcggtacaggtctttttttttagatcacc

SEQ ID NO: 9486 - DNA, 32 bp, Artificial Sequence
  Synthetic polynucleotide
gcttcggtacaggtctgaactggttttttttt

SEQ ID NO: 9487 - DNA, 32 bp, Artificial Sequence
  Synthetic polynucleotide
ttttttttacccagcagttcggctcccttgtg

SEQ ID NO: 9488 - DNA, 32 bp, Artificial Sequence
  Synthetic polynucleotide
attagtgtttttttttgttcggctcccttgtg

SEQ ID NO: 9489 - DNA, 32 bp, Artificial Sequence
  Synthetic polynucleotide
attagtgtacccagcattttttttcccttgtg

SEQ ID NO: 9490 - DNA, 32 bp, Artificial Sequence
  Synthetic polynucleotide
attagtgtacccagcagttcggcttttttttt

SEQ ID NO: 9491 - DNA, 32 bp, Artificial Sequence
  Synthetic polynucleotide
tttttttttaatgctgttccggggtaaatcaa

SEQ ID NO: 9492 - DNA, 32 bp, Artificial Sequence
  Synthetic polynucleotide
tcgtcgtgttttttttttccggggtaaatcaa

SEQ ID NO: 9493 - DNA, 32 bp, Artificial Sequence
  Synthetic polynucleotide
tcgtcgtgtaatgctgtttttttttaaatcaa

SEQ ID NO: 9494 - DNA, 32 bp, Artificial Sequence
  Synthetic polynucleotide
tcgtcgtgtaatgctgttccggggtttttttt

SEQ ID NO: 9495 - DNA, 32 bp, Artificial Sequence
  Synthetic polynucleotide
ttttttttttccaaactttagagcccggccgt

SEQ ID NO: 9496 - DNA, 32 bp, Artificial Sequence
  Synthetic polynucleotide
acgctctgtttttttttttagagcccggccgt

SEQ ID NO: 9497 - DNA, 32 bp, Artificial Sequence
  Synthetic polynucleotide
acgctctgttccaaacttttttttccggccgt

SEQ ID NO: 9498 - DNA, 32 bp, Artificial Sequence
  Synthetic polynucleotide
acgctctgttccaaactttagagctttttttt

SEQ ID NO: 9499 - DNA, 32 bp, Artificial Sequence
  Synthetic polynucleotide
ttttttttatacgagcgtggagggaagttatt

SEQ ID NO: 9500 - DNA, 32 bp, Artificial Sequence
  Synthetic polynucleotide
acccaatcttttttttgtggagggaagttatt

SEQ ID NO: 9501 - DNA, 32 bp, Artificial Sequence
  Synthetic polynucleotide
acccaatcatacgagcttttttttaagttatt

SEQ ID NO: 9502 - DNA, 32 bp, Artificial Sequence
  Synthetic polynucleotide
acccaatcatacgagcgtggagggtttttttt

SEQ ID NO: 9503 - DNA, 32 bp, Artificial Sequence
  Synthetic polynucleotide
ttttttttgttttcatatatcagagagcacag

SEQ ID NO: 9504 - DNA, 32 bp, Artificial Sequence
  Synthetic polynucleotide
ctactggcttttttttatatcagagagcacag

SEQ ID NO: 9505 - DNA, 32 bp, Artificial Sequence
  Synthetic polynucleotide
ctactggcgttttcatttttttttgagcacag

SEQ ID NO: 9506 - DNA, 32 bp, Artificial Sequence
  Synthetic polynucleotide
ctactggcgttttcatatatcagatttttttt

SEQ ID NO: 9507 - DNA, 32 bp, Artificial Sequence
  Synthetic polynucleotide
ttttttttagcccggcgtattatcgcgtcaat

SEQ ID NO: 9508 - DNA, 32 bp, Artificial Sequence
  Synthetic polynucleotide
taattcggttttttttgtattatcgcgtcaat

SEQ ID NO: 9509 - DNA, 32 bp, Artificial Sequence
  Synthetic polynucleotide
taattcggagcccggcttttttttgcgtcaat

SEQ ID NO: 9510 - DNA, 32 bp, Artificial Sequence
  Synthetic polynucleotide
taattcggagcccggcgtattatctttttttt

SEQ ID NO: 9511 - DNA, 32 bp, Artificial Sequence
  Synthetic polynucleotide
ttttttttacacaccagattacggcggcttag

SEQ ID NO: 9512 - DNA, 32 bp, Artificial Sequence
  Synthetic polynucleotide
tcatatggttttttttgattacggcggcttag

SEQ ID NO: 9513 - DNA, 32 bp, Artificial Sequence
  Synthetic polynucleotide
tcatatggacacaccattttttttcggcttag

SEQ ID NO: 9514 - DNA, 32 bp, Artificial Sequence
  Synthetic polynucleotide
tcatatggacacaccagattacggtttttttt

SEQ ID NO: 9515 - DNA, 32 bp, Artificial Sequence
  Synthetic polynucleotide
ttttttttagtacaagtgacgaagaataccgt

SEQ ID NO: 9516 - DNA, 32 bp, Artificial Sequence
  Synthetic polynucleotide
gggaattgtttttttttgacgaagaataccgt

SEQ ID NO: 9517 - DNA, 32 bp, Artificial Sequence
  Synthetic polynucleotide
gggaattgagtacaagttttttttaataccgt

SEQ ID NO: 9518 - DNA, 32 bp, Artificial Sequence
  Synthetic polynucleotide
gggaattgagtacaagtgacgaagtttttttt

SEQ ID NO: 9519 - DNA, 32 bp, Artificial Sequence
  Synthetic polynucleotide
tttttttttggagctgtcaggcttctccgtca

SEQ ID NO: 9520 - DNA, 32 bp, Artificial Sequence
  Synthetic polynucleotide
ccatcagatttttttttcaggcttctccgtca

SEQ ID NO: 9521 - DNA, 32 bp, Artificial Sequence
  Synthetic polynucleotide
ccatcagatggagctgttttttttctccgtca

SEQ ID NO: 9522 - DNA, 32 bp, Artificial Sequence
  Synthetic polynucleotide
ccatcagatggagctgtcaggctttttttttt

SEQ ID NO: 9523 - DNA, 32 bp, Artificial Sequence
  Synthetic polynucleotide
ttttttttgctgagattgattggtttagtgta

SEQ ID NO: 9524 - DNA, 32 bp, Artificial Sequence
  Synthetic polynucleotide
aaatgttgtttttttttgattggtttagtgta

SEQ ID NO: 9525 - DNA, 32 bp, Artificial Sequence
  Synthetic polynucleotide
aaatgttggctgagatttttttttttagtgta

SEQ ID NO: 9526 - DNA, 32 bp, Artificial Sequence
  Synthetic polynucleotide
aaatgttggctgagattgattggttttttttt

SEQ ID NO: 9527 - DNA, 32 bp, Artificial Sequence
  Synthetic polynucleotide
ttttttttaagagatatgtgggaggatcatta

SEQ ID NO: 9528 - DNA, 32 bp, Artificial Sequence
  Synthetic polynucleotide
tagcgagttttttttttgtgggaggatcatta

SEQ ID NO: 9529 - DNA, 32 bp, Artificial Sequence
  Synthetic polynucleotide
tagcgagtaagagatattttttttgatcatta

SEQ ID NO: 9530 - DNA, 32 bp, Artificial Sequence
  Synthetic polynucleotide
tagcgagtaagagatatgtgggagtttttttt

SEQ ID NO: 9531 - DNA, 32 bp, Artificial Sequence
  Synthetic polynucleotide
ttttttttaagttgactagcagaataatttgc

SEQ ID NO: 9532 - DNA, 32 bp, Artificial Sequence
  Synthetic polynucleotide
caggatcatttttttttagcagaataatttgc

SEQ ID NO: 9533 - DNA, 32 bp, Artificial Sequence
  Synthetic polynucleotide
caggatcaaagttgactttttttttaatttgc

SEQ ID NO: 9534 - DNA, 32 bp, Artificial Sequence
  Synthetic polynucleotide
caggatcaaagttgactagcagaatttttttt

SEQ ID NO: 9535 - DNA, 32 bp, Artificial Sequence
  Synthetic polynucleotide
ttttttttaaggtacgcaattactatttgtac

SEQ ID NO: 9536 - DNA, 32 bp, Artificial Sequence
  Synthetic polynucleotide
atccgaatttttttttcaattactatttgtac

SEQ ID NO: 9537 - DNA, 32 bp, Artificial Sequence
  Synthetic polynucleotide
atccgaataaggtacgttttttttatttgtac

SEQ ID NO: 9538 - DNA, 32 bp, Artificial Sequence
  Synthetic polynucleotide
atccgaataaggtacgcaattacttttttttt

SEQ ID NO: 9539 - DNA, 32 bp, Artificial Sequence
  Synthetic polynucleotide
ttttttttagggcatacagtaacgaaaagcga

SEQ ID NO: 9540 - DNA, 32 bp, Artificial Sequence
  Synthetic polynucleotide
cgaaaacattttttttcagtaacgaaaagcga

SEQ ID NO: 9541 - DNA, 32 bp, Artificial Sequence
  Synthetic polynucleotide
cgaaaacaagggcatattttttttaaaagcga

SEQ ID NO: 9542 - DNA, 32 bp, Artificial Sequence
  Synthetic polynucleotide
cgaaaacaagggcatacagtaacgtttttttt

SEQ ID NO: 9543 - DNA, 32 bp, Artificial Sequence
  Synthetic polynucleotide
ttttttttccacctagcacctcctgttagggt

SEQ ID NO: 9544 - DNA, 32 bp, Artificial Sequence
  Synthetic polynucleotide
acgagccattttttttcacctcctgttagggt

SEQ ID NO: 9545 - DNA, 32 bp, Artificial Sequence
  Synthetic polynucleotide
acgagccaccacctagttttttttgttagggt

SEQ ID NO: 9546 - DNA, 32 bp, Artificial Sequence
  Synthetic polynucleotide
acgagccaccacctagcacctccttttttttt

SEQ ID NO: 9547 - DNA, 32 bp, Artificial Sequence
  Synthetic polynucleotide
ttttttttggatgggttgttcatcggtcaccc

SEQ ID NO: 9548 - DNA, 32 bp, Artificial Sequence
  Synthetic polynucleotide
gacacccgtttttttttgttcatcggtcaccc

SEQ ID NO: 9549 - DNA, 32 bp, Artificial Sequence
  Synthetic polynucleotide
gacacccgggatgggtttttttttggtcaccc

SEQ ID NO: 9550 - DNA, 32 bp, Artificial Sequence
  Synthetic polynucleotide
gacacccgggatgggttgttcatctttttttt

SEQ ID NO: 9551 - DNA, 32 bp, Artificial Sequence
  Synthetic polynucleotide
ttttttttgcttgaggaatagtccaagaaatg

SEQ ID NO: 9552 - DNA, 32 bp, Artificial Sequence
  Synthetic polynucleotide
cagttttcttttttttaatagtccaagaaatg

SEQ ID NO: 9553 - DNA, 32 bp, Artificial Sequence
  Synthetic polynucleotide
cagttttcgcttgaggttttttttaagaaatg

SEQ ID NO: 9554 - DNA, 32 bp, Artificial Sequence
  Synthetic polynucleotide
cagttttcgcttgaggaatagtcctttttttt

SEQ ID NO: 9555 - DNA, 32 bp, Artificial Sequence
  Synthetic polynucleotide
ttttttttaagttgtgccgcactggaatctga

SEQ ID NO: 9556 - DNA, 32 bp, Artificial Sequence
  Synthetic polynucleotide
catgataattttttttccgcactggaatctga

SEQ ID NO: 9557 - DNA, 32 bp, Artificial Sequence
  Synthetic polynucleotide
catgataaaagttgtgttttttttgaatctga

SEQ ID NO: 9558 - DNA, 32 bp, Artificial Sequence
  Synthetic polynucleotide
catgataaaagttgtgccgcactgtttttttt

SEQ ID NO: 9559 - DNA, 32 bp, Artificial Sequence
  Synthetic polynucleotide
ttttttttcggttctcgagacactcatttact

SEQ ID NO: 9560 - DNA, 32 bp, Artificial Sequence
  Synthetic polynucleotide
agatgcacttttttttgagacactcatttact

SEQ ID NO: 9561 - DNA, 32 bp, Artificial Sequence
  Synthetic polynucleotide
agatgcaccggttctcttttttttcatttact

SEQ ID NO: 9562 - DNA, 32 bp, Artificial Sequence
  Synthetic polynucleotide
agatgcaccggttctcgagacacttttttttt

SEQ ID NO: 9563 - DNA, 32 bp, Artificial Sequence
  Synthetic polynucleotide
ttttttttgaccatgtctccagtattgccatt

SEQ ID NO: 9564 - DNA, 32 bp, Artificial Sequence
  Synthetic polynucleotide
gctcggtattttttttctccagtattgccatt

SEQ ID NO: 9565 - DNA, 32 bp, Artificial Sequence
  Synthetic polynucleotide
gctcggtagaccatgtttttttttttgccatt

SEQ ID NO: 9566 - DNA, 32 bp, Artificial Sequence
  Synthetic polynucleotide
gctcggtagaccatgtctccagtatttttttt

SEQ ID NO: 9567 - DNA, 32 bp, Artificial Sequence
  Synthetic polynucleotide
ttttttttaatacttttaatataatgtccgcg

SEQ ID NO: 9568 - DNA, 32 bp, Artificial Sequence
  Synthetic polynucleotide
ttctaatttttttttttaatataatgtccgcg

SEQ ID NO: 9569 - DNA, 32 bp, Artificial Sequence
  Synthetic polynucleotide
ttctaattaatacttttttttttttgtccgcg

SEQ ID NO: 9570 - DNA, 32 bp, Artificial Sequence
  Synthetic polynucleotide
ttctaattaatacttttaatataatttttttt

SEQ ID NO: 9571 - DNA, 32 bp, Artificial Sequence
  Synthetic polynucleotide
ttttttttaattcgacacaatggtatcttttg

SEQ ID NO: 9572 - DNA, 32 bp, Artificial Sequence
  Synthetic polynucleotide
gatcagcgttttttttacaatggtatcttttg

SEQ ID NO: 9573 - DNA, 32 bp, Artificial Sequence
  Synthetic polynucleotide
gatcagcgaattcgacttttttttatcttttg

SEQ ID NO: 9574 - DNA, 32 bp, Artificial Sequence
  Synthetic polynucleotide
gatcagcgaattcgacacaatggttttttttt

SEQ ID NO: 9575 - DNA, 32 bp, Artificial Sequence
  Synthetic polynucleotide
ttttttttgtaaaccgcttgcctgggccaata

SEQ ID NO: 9576 - DNA, 32 bp, Artificial Sequence
  Synthetic polynucleotide
aagcgcacttttttttcttgcctgggccaata

SEQ ID NO: 9577 - DNA, 32 bp, Artificial Sequence
  Synthetic polynucleotide
aagcgcacgtaaaccgttttttttggccaata

SEQ ID NO: 9578 - DNA, 32 bp, Artificial Sequence
  Synthetic polynucleotide
aagcgcacgtaaaccgcttgcctgtttttttt

SEQ ID NO: 9579 - DNA, 32 bp, Artificial Sequence
  Synthetic polynucleotide
ttttttttctgacacccagctcccaggtaagt

SEQ ID NO: 9580 - DNA, 32 bp, Artificial Sequence
  Synthetic polynucleotide
atataggtttttttttcagctcccaggtaagt

SEQ ID NO: 9581 - DNA, 32 bp, Artificial Sequence
  Synthetic polynucleotide
atataggtctgacaccttttttttaggtaagt

SEQ ID NO: 9582 - DNA, 32 bp, Artificial Sequence
  Synthetic polynucleotide
atataggtctgacacccagctccctttttttt

SEQ ID NO: 9583 - DNA, 32 bp, Artificial Sequence
  Synthetic polynucleotide
ttttttttacaatatgtattaagttttcgccg

SEQ ID NO: 9584 - DNA, 32 bp, Artificial Sequence
  Synthetic polynucleotide
aatggtcgtttttttttattaagttttcgccg

SEQ ID NO: 9585 - DNA, 32 bp, Artificial Sequence
  Synthetic polynucleotide
aatggtcgacaatatgtttttttttttcgccg

SEQ ID NO: 9586 - DNA, 32 bp, Artificial Sequence
  Synthetic polynucleotide
aatggtcgacaatatgtattaagttttttttt

SEQ ID NO: 9587 - DNA, 32 bp, Artificial Sequence
  Synthetic polynucleotide
tttttttttcttaatgtataattcatcctgtg

SEQ ID NO: 9588 - DNA, 32 bp, Artificial Sequence
  Synthetic polynucleotide
cttctacctttttttttataattcatcctgtg

SEQ ID NO: 9589 - DNA, 32 bp, Artificial Sequence
  Synthetic polynucleotide
cttctacctcttaatgttttttttatcctgtg

SEQ ID NO: 9590 - DNA, 32 bp, Artificial Sequence
  Synthetic polynucleotide
cttctacctcttaatgtataattctttttttt

SEQ ID NO: 9591 - DNA, 32 bp, Artificial Sequence
  Synthetic polynucleotide
ttttttttcagagttcccatcggcaaaattga

SEQ ID NO: 9592 - DNA, 32 bp, Artificial Sequence
  Synthetic polynucleotide
catggaagttttttttccatcggcaaaattga

SEQ ID NO: 9593 - DNA, 32 bp, Artificial Sequence
  Synthetic polynucleotide
catggaagcagagttcttttttttaaaattga

SEQ ID NO: 9594 - DNA, 32 bp, Artificial Sequence
  Synthetic polynucleotide
catggaagcagagttcccatcggctttttttt

SEQ ID NO: 9595 - DNA, 32 bp, Artificial Sequence
  Synthetic polynucleotide
tttttttttataattaagaacattcgggttcg

SEQ ID NO: 9596 - DNA, 32 bp, Artificial Sequence
  Synthetic polynucleotide
gttaccgcttttttttagaacattcgggttcg

SEQ ID NO: 9597 - DNA, 32 bp, Artificial Sequence
  Synthetic polynucleotide
gttaccgctataattattttttttcgggttcg

SEQ ID NO: 9598 - DNA, 32 bp, Artificial Sequence
  Synthetic polynucleotide
gttaccgctataattaagaacatttttttttt

SEQ ID NO: 9599 - DNA, 32 bp, Artificial Sequence
  Synthetic polynucleotide
tttttttttatgtgatcgcctaggctaacctc

SEQ ID NO: 9600 - DNA, 32 bp, Artificial Sequence
  Synthetic polynucleotide
acgtggtcttttttttcgcctaggctaacctc

SEQ ID NO: 9601 - DNA, 32 bp, Artificial Sequence
  Synthetic polynucleotide
acgtggtctatgtgatttttttttctaacctc

SEQ ID NO: 9602 - DNA, 32 bp, Artificial Sequence
  Synthetic polynucleotide
acgtggtctatgtgatcgcctaggtttttttt

SEQ ID NO: 9603 - DNA, 32 bp, Artificial Sequence
  Synthetic polynucleotide
ttttttttaggagagggtgagctcctacgtgg

SEQ ID NO: 9604 - DNA, 32 bp, Artificial Sequence
  Synthetic polynucleotide
atgactccttttttttgtgagctcctacgtgg

SEQ ID NO: 9605 - DNA, 32 bp, Artificial Sequence
  Synthetic polynucleotide
atgactccaggagaggttttttttctacgtgg

SEQ ID NO: 9606 - DNA, 32 bp, Artificial Sequence
  Synthetic polynucleotide
atgactccaggagagggtgagctctttttttt

SEQ ID NO: 9607 - DNA, 32 bp, Artificial Sequence
  Synthetic polynucleotide
ttttttttatgccgagatctaacttgattttt

SEQ ID NO: 9608 - DNA, 32 bp, Artificial Sequence
  Synthetic polynucleotide
aagtgttattttttttatctaacttgattttt

SEQ ID NO: 9609 - DNA, 32 bp, Artificial Sequence
  Synthetic polynucleotide
aagtgttaatgccgagtttttttttgattttt

SEQ ID NO: 9610 - DNA, 32 bp, Artificial Sequence
  Synthetic polynucleotide
aagtgttaatgccgagatctaacttttttttt

SEQ ID NO: 9611 - DNA, 32 bp, Artificial Sequence
  Synthetic polynucleotide
tttttttttcgagaccttgctcttggacgtct

SEQ ID NO: 9612 - DNA, 32 bp, Artificial Sequence
  Synthetic polynucleotide
attcagaattttttttttgctcttggacgtct

SEQ ID NO: 9613 - DNA, 32 bp, Artificial Sequence
  Synthetic polynucleotide
attcagaatcgagaccttttttttggacgtct

SEQ ID NO: 9614 - DNA, 32 bp, Artificial Sequence
  Synthetic polynucleotide
attcagaatcgagaccttgctctttttttttt

SEQ ID NO: 9615 - DNA, 32 bp, Artificial Sequence
  Synthetic polynucleotide
ttttttttagcccgcggttactaggcgccttg

SEQ ID NO: 9616 - DNA, 32 bp, Artificial Sequence
  Synthetic polynucleotide
cattctatttttttttgttactaggcgccttg

SEQ ID NO: 9617 - DNA, 32 bp, Artificial Sequence
  Synthetic polynucleotide
cattctatagcccgcgttttttttgcgccttg

SEQ ID NO: 9618 - DNA, 32 bp, Artificial Sequence
  Synthetic polynucleotide
cattctatagcccgcggttactagtttttttt

SEQ ID NO: 9619 - DNA, 32 bp, Artificial Sequence
  Synthetic polynucleotide
ttttttttctcaatagtgaacccttactatcg

SEQ ID NO: 9620 - DNA, 32 bp, Artificial Sequence
  Synthetic polynucleotide
ctcctacgtttttttttgaacccttactatcg

SEQ ID NO: 9621 - DNA, 32 bp, Artificial Sequence
  Synthetic polynucleotide
ctcctacgctcaatagtttttttttactatcg

SEQ ID NO: 9622 - DNA, 32 bp, Artificial Sequence
  Synthetic polynucleotide
ctcctacgctcaatagtgaacccttttttttt

SEQ ID NO: 9623 - DNA, 32 bp, Artificial Sequence
  Synthetic polynucleotide
tttttttttaggtcaaaataaacgatacttaa

SEQ ID NO: 9624 - DNA, 32 bp, Artificial Sequence
  Synthetic polynucleotide
cgacaggattttttttaataaacgatacttaa

SEQ ID NO: 9625 - DNA, 32 bp, Artificial Sequence
  Synthetic polynucleotide
cgacaggataggtcaattttttttatacttaa

SEQ ID NO: 9626 - DNA, 32 bp, Artificial Sequence
  Synthetic polynucleotide
cgacaggataggtcaaaataaacgtttttttt

SEQ ID NO: 9627 - DNA, 32 bp, Artificial Sequence
  Synthetic polynucleotide
ttttttttaggggaaccgtagacttcacataa

SEQ ID NO: 9628 - DNA, 32 bp, Artificial Sequence
  Synthetic polynucleotide
agctctagttttttttcgtagacttcacataa

SEQ ID NO: 9629 - DNA, 32 bp, Artificial Sequence
  Synthetic polynucleotide
agctctagaggggaactttttttttcacataa

SEQ ID NO: 9630 - DNA, 32 bp, Artificial Sequence
  Synthetic polynucleotide
agctctagaggggaaccgtagacttttttttt

SEQ ID NO: 9631 - DNA, 32 bp, Artificial Sequence
  Synthetic polynucleotide
ttttttttcggcgagtgttctagggagcgggg

SEQ ID NO: 9632 - DNA, 32 bp, Artificial Sequence
  Synthetic polynucleotide
aaaacactttttttttgttctagggagcgggg

SEQ ID NO: 9633 - DNA, 32 bp, Artificial Sequence
  Synthetic polynucleotide
aaaacactcggcgagtttttttttgagcgggg

SEQ ID NO: 9634 - DNA, 32 bp, Artificial Sequence
  Synthetic polynucleotide
aaaacactcggcgagtgttctaggtttttttt

SEQ ID NO: 9635 - DNA, 32 bp, Artificial Sequence
  Synthetic polynucleotide
ttttttttcccagcattccttcagtccgccta

SEQ ID NO: 9636 - DNA, 32 bp, Artificial Sequence
  Synthetic polynucleotide
atggtacatttttttttccttcagtccgccta

SEQ ID NO: 9637 - DNA, 32 bp, Artificial Sequence
  Synthetic polynucleotide
atggtacacccagcattttttttttccgccta

SEQ ID NO: 9638 - DNA, 32 bp, Artificial Sequence
  Synthetic polynucleotide
atggtacacccagcattccttcagtttttttt

SEQ ID NO: 9639 - DNA, 32 bp, Artificial Sequence
  Synthetic polynucleotide
ttttttttctttgatattctcccaaatggata

SEQ ID NO: 9640 - DNA, 32 bp, Artificial Sequence
  Synthetic polynucleotide
ctcatgatttttttttttctcccaaatggata

SEQ ID NO: 9641 - DNA, 32 bp, Artificial Sequence
  Synthetic polynucleotide
ctcatgatctttgatattttttttaatggata

SEQ ID NO: 9642 - DNA, 32 bp, Artificial Sequence
  Synthetic polynucleotide
ctcatgatctttgatattctcccatttttttt

SEQ ID NO: 9643 - DNA, 32 bp, Artificial Sequence
  Synthetic polynucleotide
ttttttttacaaaaaacttgcctatcgtgccc

SEQ ID NO: 9644 - DNA, 32 bp, Artificial Sequence
  Synthetic polynucleotide
gggcgtaattttttttcttgcctatcgtgccc

SEQ ID NO: 9645 - DNA, 32 bp, Artificial Sequence
  Synthetic polynucleotide
gggcgtaaacaaaaaatttttttttcgtgccc

SEQ ID NO: 9646 - DNA, 32 bp, Artificial Sequence
  Synthetic polynucleotide
gggcgtaaacaaaaaacttgcctatttttttt

SEQ ID NO: 9647 - DNA, 32 bp, Artificial Sequence
  Synthetic polynucleotide
ttttttttcattgtctaccacctatgttctta

SEQ ID NO: 9648 - DNA, 32 bp, Artificial Sequence
  Synthetic polynucleotide
tcatacagttttttttaccacctatgttctta

SEQ ID NO: 9649 - DNA, 32 bp, Artificial Sequence
  Synthetic polynucleotide
tcatacagcattgtcttttttttttgttctta

SEQ ID NO: 9650 - DNA, 32 bp, Artificial Sequence
  Synthetic polynucleotide
tcatacagcattgtctaccacctatttttttt

SEQ ID NO: 9651 - DNA, 32 bp, Artificial Sequence
  Synthetic polynucleotide
ttttttttacatagatcgtcgggcgaccttcg

SEQ ID NO: 9652 - DNA, 32 bp, Artificial Sequence
  Synthetic polynucleotide
tgctgttattttttttcgtcgggcgaccttcg

SEQ ID NO: 9653 - DNA, 32 bp, Artificial Sequence
  Synthetic polynucleotide
tgctgttaacatagatttttttttgaccttcg

SEQ ID NO: 9654 - DNA, 32 bp, Artificial Sequence
  Synthetic polynucleotide
tgctgttaacatagatcgtcgggctttttttt

SEQ ID NO: 9655 - DNA, 32 bp, Artificial Sequence
  Synthetic polynucleotide
ttttttttggccgaccaccgaccaaggcgcta

SEQ ID NO: 9656 - DNA, 32 bp, Artificial Sequence
  Synthetic polynucleotide
taaggtggttttttttaccgaccaaggcgcta

SEQ ID NO: 9657 - DNA, 32 bp, Artificial Sequence
  Synthetic polynucleotide
taaggtggggccgaccttttttttaggcgcta

SEQ ID NO: 9658 - DNA, 32 bp, Artificial Sequence
  Synthetic polynucleotide
taaggtggggccgaccaccgaccatttttttt

SEQ ID NO: 9659 - DNA, 32 bp, Artificial Sequence
  Synthetic polynucleotide
ttttttttactcgtaagcgatatctgaatgcg

SEQ ID NO: 9660 - DNA, 32 bp, Artificial Sequence
  Synthetic polynucleotide
tagggtatttttttttgcgatatctgaatgcg

SEQ ID NO: 9661 - DNA, 32 bp, Artificial Sequence
  Synthetic polynucleotide
tagggtatactcgtaatttttttttgaatgcg

SEQ ID NO: 9662 - DNA, 32 bp, Artificial Sequence
  Synthetic polynucleotide
tagggtatactcgtaagcgatatctttttttt

SEQ ID NO: 9663 - DNA, 32 bp, Artificial Sequence
  Synthetic polynucleotide
ttttttttaacgacaaaaaataccttcgccgg

SEQ ID NO: 9664 - DNA, 32 bp, Artificial Sequence
  Synthetic polynucleotide
taatacgattttttttaaaataccttcgccgg

SEQ ID NO: 9665 - DNA, 32 bp, Artificial Sequence
  Synthetic polynucleotide
taatacgaaacgacaattttttttttcgccgg

SEQ ID NO: 9666 - DNA, 32 bp, Artificial Sequence
  Synthetic polynucleotide
taatacgaaacgacaaaaaatacctttttttt

SEQ ID NO: 9667 - DNA, 32 bp, Artificial Sequence
  Synthetic polynucleotide
ttttttttttggagcccacgaaccaacgcatc

SEQ ID NO: 9668 - DNA, 32 bp, Artificial Sequence
  Synthetic polynucleotide
tccgtccgttttttttcacgaaccaacgcatc

SEQ ID NO: 9669 - DNA, 32 bp, Artificial Sequence
  Synthetic polynucleotide
tccgtccgttggagccttttttttaacgcatc

SEQ ID NO: 9670 - DNA, 32 bp, Artificial Sequence
  Synthetic polynucleotide
tccgtccgttggagcccacgaacctttttttt

SEQ ID NO: 9671 - DNA, 32 bp, Artificial Sequence
  Synthetic polynucleotide
ttttttttcggaggcgcattaggtctattata

SEQ ID NO: 9672 - DNA, 32 bp, Artificial Sequence
  Synthetic polynucleotide
accattacttttttttcattaggtctattata

SEQ ID NO: 9673 - DNA, 32 bp, Artificial Sequence
  Synthetic polynucleotide
accattaccggaggcgttttttttctattata

SEQ ID NO: 9674 - DNA, 32 bp, Artificial Sequence
  Synthetic polynucleotide
accattaccggaggcgcattaggttttttttt

SEQ ID NO: 9675 - DNA, 32 bp, Artificial Sequence
  Synthetic polynucleotide
tttttttttataaaatggcactgtcacggcgc

SEQ ID NO: 9676 - DNA, 32 bp, Artificial Sequence
  Synthetic polynucleotide
tatcgttcttttttttggcactgtcacggcgc

SEQ ID NO: 9677 - DNA, 32 bp, Artificial Sequence
  Synthetic polynucleotide
tatcgttctataaaatttttttttcacggcgc

SEQ ID NO: 9678 - DNA, 32 bp, Artificial Sequence
  Synthetic polynucleotide
tatcgttctataaaatggcactgttttttttt

SEQ ID NO: 9679 - DNA, 32 bp, Artificial Sequence
  Synthetic polynucleotide
tttttttttacaatgtgtctgacccttcacat

SEQ ID NO: 9680 - DNA, 32 bp, Artificial Sequence
  Synthetic polynucleotide
atatcatcttttttttgtctgacccttcacat

SEQ ID NO: 9681 - DNA, 32 bp, Artificial Sequence
  Synthetic polynucleotide
atatcatctacaatgtttttttttcttcacat

SEQ ID NO: 9682 - DNA, 32 bp, Artificial Sequence
  Synthetic polynucleotide
atatcatctacaatgtgtctgacctttttttt

SEQ ID NO: 9683 - DNA, 32 bp, Artificial Sequence
  Synthetic polynucleotide
ttttttttggattacccttcaataagttgtag

SEQ ID NO: 9684 - DNA, 32 bp, Artificial Sequence
  Synthetic polynucleotide
taatatggttttttttcttcaataagttgtag

SEQ ID NO: 9685 - DNA, 32 bp, Artificial Sequence
  Synthetic polynucleotide
taatatggggattaccttttttttagttgtag

SEQ ID NO: 9686 - DNA, 32 bp, Artificial Sequence
  Synthetic polynucleotide
taatatggggattacccttcaatatttttttt

SEQ ID NO: 9687 - DNA, 32 bp, Artificial Sequence
  Synthetic polynucleotide
tttttttttggcaggtgccatcctacccgctt

SEQ ID NO: 9688 - DNA, 32 bp, Artificial Sequence
  Synthetic polynucleotide
gcatcagcttttttttgccatcctacccgctt

SEQ ID NO: 9689 - DNA, 32 bp, Artificial Sequence
  Synthetic polynucleotide
gcatcagctggcaggtttttttttacccgctt

SEQ ID NO: 9690 - DNA, 32 bp, Artificial Sequence
  Synthetic polynucleotide
gcatcagctggcaggtgccatccttttttttt

SEQ ID NO: 9691 - DNA, 32 bp, Artificial Sequence
  Synthetic polynucleotide
ttttttttgaagcaggatgtgtaatggtgggc

SEQ ID NO: 9692 - DNA, 32 bp, Artificial Sequence
  Synthetic polynucleotide
tctcatgcttttttttatgtgtaatggtgggc

SEQ ID NO: 9693 - DNA, 32 bp, Artificial Sequence
  Synthetic polynucleotide
tctcatgcgaagcaggtttttttttggtgggc

SEQ ID NO: 9694 - DNA, 32 bp, Artificial Sequence
  Synthetic polynucleotide
tctcatgcgaagcaggatgtgtaatttttttt

SEQ ID NO: 9695 - DNA, 32 bp, Artificial Sequence
  Synthetic polynucleotide
tttttttttctgcgccagcgccacgtccccaa

SEQ ID NO: 9696 - DNA, 32 bp, Artificial Sequence
  Synthetic polynucleotide
ggacgatattttttttagcgccacgtccccaa

SEQ ID NO: 9697 - DNA, 32 bp, Artificial Sequence
  Synthetic polynucleotide
ggacgatatctgcgccttttttttgtccccaa

SEQ ID NO: 9698 - DNA, 32 bp, Artificial Sequence
  Synthetic polynucleotide
ggacgatatctgcgccagcgccactttttttt

SEQ ID NO: 9699 - DNA, 32 bp, Artificial Sequence
  Synthetic polynucleotide
ttttttttacctgtcattggagtgatgaacaa

SEQ ID NO: 9700 - DNA, 32 bp, Artificial Sequence
  Synthetic polynucleotide
ttgtcgggttttttttttggagtgatgaacaa

SEQ ID NO: 9701 - DNA, 32 bp, Artificial Sequence
  Synthetic polynucleotide
ttgtcgggacctgtcattttttttatgaacaa

SEQ ID NO: 9702 - DNA, 32 bp, Artificial Sequence
  Synthetic polynucleotide
ttgtcgggacctgtcattggagtgtttttttt

SEQ ID NO: 9703 - DNA, 32 bp, Artificial Sequence
  Synthetic polynucleotide
ttttttttctgctgccgccctttggggttcac

SEQ ID NO: 9704 - DNA, 32 bp, Artificial Sequence
  Synthetic polynucleotide
cctgggtcttttttttgccctttggggttcac

SEQ ID NO: 9705 - DNA, 32 bp, Artificial Sequence
  Synthetic polynucleotide
cctgggtcctgctgccttttttttgggttcac

SEQ ID NO: 9706 - DNA, 32 bp, Artificial Sequence
  Synthetic polynucleotide
cctgggtcctgctgccgccctttgtttttttt

SEQ ID NO: 9707 - DNA, 32 bp, Artificial Sequence
  Synthetic polynucleotide
ttttttttataacctaagtaatgtctagtgcc

SEQ ID NO: 9708 - DNA, 32 bp, Artificial Sequence
  Synthetic polynucleotide
gcccgcgcttttttttagtaatgtctagtgcc

SEQ ID NO: 9709 - DNA, 32 bp, Artificial Sequence
  Synthetic polynucleotide
gcccgcgcataacctattttttttctagtgcc

SEQ ID NO: 9710 - DNA, 32 bp, Artificial Sequence
  Synthetic polynucleotide
gcccgcgcataacctaagtaatgttttttttt

SEQ ID NO: 9711 - DNA, 32 bp, Artificial Sequence
  Synthetic polynucleotide
ttttttttaagagtcaagcgtaaagtcttgac

SEQ ID NO: 9712 - DNA, 32 bp, Artificial Sequence
  Synthetic polynucleotide
gtatgtgattttttttagcgtaaagtcttgac

SEQ ID NO: 9713 - DNA, 32 bp, Artificial Sequence
  Synthetic polynucleotide
gtatgtgaaagagtcattttttttgtcttgac

SEQ ID NO: 9714 - DNA, 32 bp, Artificial Sequence
  Synthetic polynucleotide
gtatgtgaaagagtcaagcgtaaatttttttt

SEQ ID NO: 9715 - DNA, 32 bp, Artificial Sequence
  Synthetic polynucleotide
tttttttttccagctgacggtatggaaagaag

SEQ ID NO: 9716 - DNA, 32 bp, Artificial Sequence
  Synthetic polynucleotide
gtattccattttttttacggtatggaaagaag

SEQ ID NO: 9717 - DNA, 32 bp, Artificial Sequence
  Synthetic polynucleotide
gtattccatccagctgttttttttgaaagaag

SEQ ID NO: 9718 - DNA, 32 bp, Artificial Sequence
  Synthetic polynucleotide
gtattccatccagctgacggtatgtttttttt

SEQ ID NO: 9719 - DNA, 32 bp, Artificial Sequence
  Synthetic polynucleotide
ttttttttctcgagtctacagcagagctacgc

SEQ ID NO: 9720 - DNA, 32 bp, Artificial Sequence
  Synthetic polynucleotide
cgaaggggtttttttttacagcagagctacgc

SEQ ID NO: 9721 - DNA, 32 bp, Artificial Sequence
  Synthetic polynucleotide
cgaaggggctcgagtcttttttttagctacgc

SEQ ID NO: 9722 - DNA, 32 bp, Artificial Sequence
  Synthetic polynucleotide
cgaaggggctcgagtctacagcagtttttttt

SEQ ID NO: 9723 - DNA, 32 bp, Artificial Sequence
  Synthetic polynucleotide
tttttttttctttaaatgtcccgtgttagggc

SEQ ID NO: 9724 - DNA, 32 bp, Artificial Sequence
  Synthetic polynucleotide
gtcccacgtttttttttgtcccgtgttagggc

SEQ ID NO: 9725 - DNA, 32 bp, Artificial Sequence
  Synthetic polynucleotide
gtcccacgtctttaaattttttttgttagggc

SEQ ID NO: 9726 - DNA, 32 bp, Artificial Sequence
  Synthetic polynucleotide
gtcccacgtctttaaatgtcccgttttttttt

SEQ ID NO: 9727 - DNA, 32 bp, Artificial Sequence
  Synthetic polynucleotide
ttttttttcgtggaatccattcagttcacagg

SEQ ID NO: 9728 - DNA, 32 bp, Artificial Sequence
  Synthetic polynucleotide
tcgcatctttttttttccattcagttcacagg

SEQ ID NO: 9729 - DNA, 32 bp, Artificial Sequence
  Synthetic polynucleotide
tcgcatctcgtggaatttttttttttcacagg

SEQ ID NO: 9730 - DNA, 32 bp, Artificial Sequence
  Synthetic polynucleotide
tcgcatctcgtggaatccattcagtttttttt

SEQ ID NO: 9731 - DNA, 32 bp, Artificial Sequence
  Synthetic polynucleotide
ttttttttcgtacaaagcgttactgacccgct

SEQ ID NO: 9732 - DNA, 32 bp, Artificial Sequence
  Synthetic polynucleotide
cccttagcttttttttgcgttactgacccgct

SEQ ID NO: 9733 - DNA, 32 bp, Artificial Sequence
  Synthetic polynucleotide
cccttagccgtacaaattttttttgacccgct

SEQ ID NO: 9734 - DNA, 32 bp, Artificial Sequence
  Synthetic polynucleotide
cccttagccgtacaaagcgttacttttttttt

SEQ ID NO: 9735 - DNA, 32 bp, Artificial Sequence
  Synthetic polynucleotide
ttttttttatgcaaaactatgtctttctgagg

SEQ ID NO: 9736 - DNA, 32 bp, Artificial Sequence
  Synthetic polynucleotide
gcaggtaattttttttctatgtctttctgagg

SEQ ID NO: 9737 - DNA, 32 bp, Artificial Sequence
  Synthetic polynucleotide
gcaggtaaatgcaaaattttttttttctgagg

SEQ ID NO: 9738 - DNA, 32 bp, Artificial Sequence
  Synthetic polynucleotide
gcaggtaaatgcaaaactatgtcttttttttt

SEQ ID NO: 9739 - DNA, 32 bp, Artificial Sequence
  Synthetic polynucleotide
tttttttttttgggtctacggcaccgaggcct

SEQ ID NO: 9740 - DNA, 32 bp, Artificial Sequence
  Synthetic polynucleotide
aggagcagtttttttttacggcaccgaggcct

SEQ ID NO: 9741 - DNA, 32 bp, Artificial Sequence
  Synthetic polynucleotide
aggagcagtttgggtcttttttttcgaggcct

SEQ ID NO: 9742 - DNA, 32 bp, Artificial Sequence
  Synthetic polynucleotide
aggagcagtttgggtctacggcactttttttt

SEQ ID NO: 9743 - DNA, 32 bp, Artificial Sequence
  Synthetic polynucleotide
ttttttttgaccctaagagtccccgaagaata

SEQ ID NO: 9744 - DNA, 32 bp, Artificial Sequence
  Synthetic polynucleotide
aatccgatttttttttgagtccccgaagaata

SEQ ID NO: 9745 - DNA, 32 bp, Artificial Sequence
  Synthetic polynucleotide
aatccgatgaccctaattttttttgaagaata

SEQ ID NO: 9746 - DNA, 32 bp, Artificial Sequence
  Synthetic polynucleotide
aatccgatgaccctaagagtcccctttttttt

SEQ ID NO: 9747 - DNA, 32 bp, Artificial Sequence
  Synthetic polynucleotide
tttttttttccgccggcaagtaagcagggcgt

SEQ ID NO: 9748 - DNA, 32 bp, Artificial Sequence
  Synthetic polynucleotide
ggatattcttttttttcaagtaagcagggcgt

SEQ ID NO: 9749 - DNA, 32 bp, Artificial Sequence
  Synthetic polynucleotide
ggatattctccgccggttttttttcagggcgt

SEQ ID NO: 9750 - DNA, 32 bp, Artificial Sequence
  Synthetic polynucleotide
ggatattctccgccggcaagtaagtttttttt

SEQ ID NO: 9751 - DNA, 32 bp, Artificial Sequence
  Synthetic polynucleotide
tttttttttcaaccggcgacgagtaacggcat

SEQ ID NO: 9752 - DNA, 32 bp, Artificial Sequence
  Synthetic polynucleotide
aaaagcagttttttttcgacgagtaacggcat

SEQ ID NO: 9753 - DNA, 32 bp, Artificial Sequence
  Synthetic polynucleotide
aaaagcagtcaaccggttttttttaacggcat

SEQ ID NO: 9754 - DNA, 32 bp, Artificial Sequence
  Synthetic polynucleotide
aaaagcagtcaaccggcgacgagttttttttt

SEQ ID NO: 9755 - DNA, 32 bp, Artificial Sequence
  Synthetic polynucleotide
tttttttttttttataactgctgggtgggcgc

SEQ ID NO: 9756 - DNA, 32 bp, Artificial Sequence
  Synthetic polynucleotide
cttccgacttttttttactgctgggtgggcgc

SEQ ID NO: 9757 - DNA, 32 bp, Artificial Sequence
  Synthetic polynucleotide
cttccgactttttatattttttttgtgggcgc

SEQ ID NO: 9758 - DNA, 32 bp, Artificial Sequence
  Synthetic polynucleotide
cttccgactttttataactgctggtttttttt

SEQ ID NO: 9759 - DNA, 32 bp, Artificial Sequence
  Synthetic polynucleotide
ttttttttggacgtttgagcaatagaaattga

SEQ ID NO: 9760 - DNA, 32 bp, Artificial Sequence
  Synthetic polynucleotide
cactgtgtttttttttgagcaatagaaattga

SEQ ID NO: 9761 - DNA, 32 bp, Artificial Sequence
  Synthetic polynucleotide
cactgtgtggacgtttttttttttgaaattga

SEQ ID NO: 9762 - DNA, 32 bp, Artificial Sequence
  Synthetic polynucleotide
cactgtgtggacgtttgagcaatatttttttt

SEQ ID NO: 9763 - DNA, 32 bp, Artificial Sequence
  Synthetic polynucleotide
ttttttttaagacgtagaatgagcgacgcacc

SEQ ID NO: 9764 - DNA, 32 bp, Artificial Sequence
  Synthetic polynucleotide
atcggctcttttttttgaatgagcgacgcacc

SEQ ID NO: 9765 - DNA, 32 bp, Artificial Sequence
  Synthetic polynucleotide
atcggctcaagacgtattttttttgacgcacc

SEQ ID NO: 9766 - DNA, 32 bp, Artificial Sequence
  Synthetic polynucleotide
atcggctcaagacgtagaatgagctttttttt

SEQ ID NO: 9767 - DNA, 32 bp, Artificial Sequence
  Synthetic polynucleotide
ttttttttacaacatgactacagttgaccggg

SEQ ID NO: 9768 - DNA, 32 bp, Artificial Sequence
  Synthetic polynucleotide
tgtccaagttttttttactacagttgaccggg

SEQ ID NO: 9769 - DNA, 32 bp, Artificial Sequence
  Synthetic polynucleotide
tgtccaagacaacatgtttttttttgaccggg

SEQ ID NO: 9770 - DNA, 32 bp, Artificial Sequence
  Synthetic polynucleotide
tgtccaagacaacatgactacagttttttttt

SEQ ID NO: 9771 - DNA, 32 bp, Artificial Sequence
  Synthetic polynucleotide
ttttttttaagcgcaacggcgccgattgatca

SEQ ID NO: 9772 - DNA, 32 bp, Artificial Sequence
  Synthetic polynucleotide
ggtgcaaattttttttcggcgccgattgatca

SEQ ID NO: 9773 - DNA, 32 bp, Artificial Sequence
  Synthetic polynucleotide
ggtgcaaaaagcgcaattttttttattgatca

SEQ ID NO: 9774 - DNA, 32 bp, Artificial Sequence
  Synthetic polynucleotide
ggtgcaaaaagcgcaacggcgccgtttttttt

SEQ ID NO: 9775 - DNA, 32 bp, Artificial Sequence
  Synthetic polynucleotide
ttttttttgtataggtccttgttacgatggca

SEQ ID NO: 9776 - DNA, 32 bp, Artificial Sequence
  Synthetic polynucleotide
atggttaattttttttccttgttacgatggca

SEQ ID NO: 9777 - DNA, 32 bp, Artificial Sequence
  Synthetic polynucleotide
atggttaagtataggtttttttttcgatggca

SEQ ID NO: 9778 - DNA, 32 bp, Artificial Sequence
  Synthetic polynucleotide
atggttaagtataggtccttgttatttttttt

SEQ ID NO: 9779 - DNA, 32 bp, Artificial Sequence
  Synthetic polynucleotide
ttttttttcggaccttccaccgggtctgttcc

SEQ ID NO: 9780 - DNA, 32 bp, Artificial Sequence
  Synthetic polynucleotide
gcaatattttttttttccaccgggtctgttcc

SEQ ID NO: 9781 - DNA, 32 bp, Artificial Sequence
  Synthetic polynucleotide
gcaatattcggacctttttttttttctgttcc

SEQ ID NO: 9782 - DNA, 32 bp, Artificial Sequence
  Synthetic polynucleotide
gcaatattcggaccttccaccgggtttttttt

SEQ ID NO: 9783 - DNA, 32 bp, Artificial Sequence
  Synthetic polynucleotide
ttttttttggaatactcagccttcaccgcggg

SEQ ID NO: 9784 - DNA, 32 bp, Artificial Sequence
  Synthetic polynucleotide
attgagcattttttttcagccttcaccgcggg

SEQ ID NO: 9785 - DNA, 32 bp, Artificial Sequence
  Synthetic polynucleotide
attgagcaggaatactttttttttaccgcggg

SEQ ID NO: 9786 - DNA, 32 bp, Artificial Sequence
  Synthetic polynucleotide
attgagcaggaatactcagccttctttttttt

SEQ ID NO: 9787 - DNA, 32 bp, Artificial Sequence
  Synthetic polynucleotide
ttttttttgtacacatctctggctttaccaag

SEQ ID NO: 9788 - DNA, 32 bp, Artificial Sequence
  Synthetic polynucleotide
tctctatcttttttttctctggctttaccaag

SEQ ID NO: 9789 - DNA, 32 bp, Artificial Sequence
  Synthetic polynucleotide
tctctatcgtacacatttttttttttaccaag

SEQ ID NO: 9790 - DNA, 32 bp, Artificial Sequence
  Synthetic polynucleotide
tctctatcgtacacatctctggcttttttttt

SEQ ID NO: 9791 - DNA, 32 bp, Artificial Sequence
  Synthetic polynucleotide
ttttttttgggacagtcggaacatgcacgatg

SEQ ID NO: 9792 - DNA, 32 bp, Artificial Sequence
  Synthetic polynucleotide
ccactaacttttttttcggaacatgcacgatg

SEQ ID NO: 9793 - DNA, 32 bp, Artificial Sequence
  Synthetic polynucleotide
ccactaacgggacagtttttttttgcacgatg

SEQ ID NO: 9794 - DNA, 32 bp, Artificial Sequence
  Synthetic polynucleotide
ccactaacgggacagtcggaacattttttttt

SEQ ID NO: 9795 - DNA, 32 bp, Artificial Sequence
  Synthetic polynucleotide
ttttttttgggtgccaccgcaacctttacgtg

SEQ ID NO: 9796 - DNA, 32 bp, Artificial Sequence
  Synthetic polynucleotide
tccgggatttttttttccgcaacctttacgtg

SEQ ID NO: 9797 - DNA, 32 bp, Artificial Sequence
  Synthetic polynucleotide
tccgggatgggtgccatttttttttttacgtg

SEQ ID NO: 9798 - DNA, 32 bp, Artificial Sequence
  Synthetic polynucleotide
tccgggatgggtgccaccgcaacctttttttt

SEQ ID NO: 9799 - DNA, 32 bp, Artificial Sequence
  Synthetic polynucleotide
ttttttttatacaagattcagcagccttactc

SEQ ID NO: 9800 - DNA, 32 bp, Artificial Sequence
  Synthetic polynucleotide
tttagggattttttttttcagcagccttactc

SEQ ID NO: 9801 - DNA, 32 bp, Artificial Sequence
  Synthetic polynucleotide
tttagggaatacaagattttttttccttactc

SEQ ID NO: 9802 - DNA, 32 bp, Artificial Sequence
  Synthetic polynucleotide
tttagggaatacaagattcagcagtttttttt

SEQ ID NO: 9803 - DNA, 32 bp, Artificial Sequence
  Synthetic polynucleotide
ttttttttcacggacaggaacaacgggtgtca

SEQ ID NO: 9804 - DNA, 32 bp, Artificial Sequence
  Synthetic polynucleotide
agcaatatttttttttggaacaacgggtgtca

SEQ ID NO: 9805 - DNA, 32 bp, Artificial Sequence
  Synthetic polynucleotide
agcaatatcacggacattttttttgggtgtca

SEQ ID NO: 9806 - DNA, 32 bp, Artificial Sequence
  Synthetic polynucleotide
agcaatatcacggacaggaacaactttttttt

SEQ ID NO: 9807 - DNA, 32 bp, Artificial Sequence
  Synthetic polynucleotide
ttttttttaagggcaatcgtatttgatgcccg

SEQ ID NO: 9808 - DNA, 32 bp, Artificial Sequence
  Synthetic polynucleotide
gtccaagttttttttttcgtatttgatgcccg

SEQ ID NO: 9809 - DNA, 32 bp, Artificial Sequence
  Synthetic polynucleotide
gtccaagtaagggcaattttttttgatgcccg

SEQ ID NO: 9810 - DNA, 32 bp, Artificial Sequence
  Synthetic polynucleotide
gtccaagtaagggcaatcgtattttttttttt

SEQ ID NO: 9811 - DNA, 32 bp, Artificial Sequence
  Synthetic polynucleotide
ttttttttctcacttttctggcgccggcttag

SEQ ID NO: 9812 - DNA, 32 bp, Artificial Sequence
  Synthetic polynucleotide
tgtgtatgtttttttttctggcgccggcttag

SEQ ID NO: 9813 - DNA, 32 bp, Artificial Sequence
  Synthetic polynucleotide
tgtgtatgctcactttttttttttcggcttag

SEQ ID NO: 9814 - DNA, 32 bp, Artificial Sequence
  Synthetic polynucleotide
tgtgtatgctcacttttctggcgctttttttt

SEQ ID NO: 9815 - DNA, 32 bp, Artificial Sequence
  Synthetic polynucleotide
ttttttttcattgtggttcgccgcgtcgtttt

SEQ ID NO: 9816 - DNA, 32 bp, Artificial Sequence
  Synthetic polynucleotide
ccgtcacgttttttttttcgccgcgtcgtttt

SEQ ID NO: 9817 - DNA, 32 bp, Artificial Sequence
  Synthetic polynucleotide
ccgtcacgcattgtggttttttttgtcgtttt

SEQ ID NO: 9818 - DNA, 32 bp, Artificial Sequence
  Synthetic polynucleotide
ccgtcacgcattgtggttcgccgctttttttt

SEQ ID NO: 9819 - DNA, 32 bp, Artificial Sequence
  Synthetic polynucleotide
ttttttttaagattcaacaggacgatgttctc

SEQ ID NO: 9820 - DNA, 32 bp, Artificial Sequence
  Synthetic polynucleotide
ctcagtttttttttttacaggacgatgttctc

SEQ ID NO: 9821 - DNA, 32 bp, Artificial Sequence
  Synthetic polynucleotide
ctcagtttaagattcattttttttatgttctc

SEQ ID NO: 9822 - DNA, 32 bp, Artificial Sequence
  Synthetic polynucleotide
ctcagtttaagattcaacaggacgtttttttt

SEQ ID NO: 9823 - DNA, 32 bp, Artificial Sequence
  Synthetic polynucleotide
ttttttttaggtcttaattttggcggaacggg

SEQ ID NO: 9824 - DNA, 32 bp, Artificial Sequence
  Synthetic polynucleotide
acctcttcttttttttattttggcggaacggg

SEQ ID NO: 9825 - DNA, 32 bp, Artificial Sequence
  Synthetic polynucleotide
acctcttcaggtcttattttttttggaacggg

SEQ ID NO: 9826 - DNA, 32 bp, Artificial Sequence
  Synthetic polynucleotide
acctcttcaggtcttaattttggctttttttt

SEQ ID NO: 9827 - DNA, 32 bp, Artificial Sequence
  Synthetic polynucleotide
ttttttttcgtccttggcatccgctcgcatgg

SEQ ID NO: 9828 - DNA, 32 bp, Artificial Sequence
  Synthetic polynucleotide
aagcatcgttttttttgcatccgctcgcatgg

SEQ ID NO: 9829 - DNA, 32 bp, Artificial Sequence
  Synthetic polynucleotide
aagcatcgcgtccttgtttttttttcgcatgg

SEQ ID NO: 9830 - DNA, 32 bp, Artificial Sequence
  Synthetic polynucleotide
aagcatcgcgtccttggcatccgctttttttt

SEQ ID NO: 9831 - DNA, 32 bp, Artificial Sequence
  Synthetic polynucleotide
tttttttttgtggcaatacaatatagttatat

SEQ ID NO: 9832 - DNA, 32 bp, Artificial Sequence
  Synthetic polynucleotide
ttaagatgtttttttttacaatatagttatat

SEQ ID NO: 9833 - DNA, 32 bp, Artificial Sequence
  Synthetic polynucleotide
ttaagatgtgtggcaattttttttagttatat

SEQ ID NO: 9834 - DNA, 32 bp, Artificial Sequence
  Synthetic polynucleotide
ttaagatgtgtggcaatacaatattttttttt

SEQ ID NO: 9835 - DNA, 32 bp, Artificial Sequence
  Synthetic polynucleotide
ttttttttaacggtcgtatccgcctatctcgc

SEQ ID NO: 9836 - DNA, 32 bp, Artificial Sequence
  Synthetic polynucleotide
cctcatgttttttttttatccgcctatctcgc

SEQ ID NO: 9837 - DNA, 32 bp, Artificial Sequence
  Synthetic polynucleotide
cctcatgtaacggtcgtttttttttatctcgc

SEQ ID NO: 9838 - DNA, 32 bp, Artificial Sequence
  Synthetic polynucleotide
cctcatgtaacggtcgtatccgcctttttttt

SEQ ID NO: 9839 - DNA, 32 bp, Artificial Sequence
  Synthetic polynucleotide
ttttttttaccagccaagagagtcgcagccct

SEQ ID NO: 9840 - DNA, 32 bp, Artificial Sequence
  Synthetic polynucleotide
agagttctttttttttagagagtcgcagccct

SEQ ID NO: 9841 - DNA, 32 bp, Artificial Sequence
  Synthetic polynucleotide
agagttctaccagccattttttttgcagccct

SEQ ID NO: 9842 - DNA, 32 bp, Artificial Sequence
  Synthetic polynucleotide
agagttctaccagccaagagagtctttttttt

SEQ ID NO: 9843 - DNA, 32 bp, Artificial Sequence
  Synthetic polynucleotide
ttttttttggacatcacatctctgcctcgacg

SEQ ID NO: 9844 - DNA, 32 bp, Artificial Sequence
  Synthetic polynucleotide
tcatcgtattttttttcatctctgcctcgacg

SEQ ID NO: 9845 - DNA, 32 bp, Artificial Sequence
  Synthetic polynucleotide
tcatcgtaggacatcattttttttcctcgacg

SEQ ID NO: 9846 - DNA, 32 bp, Artificial Sequence
  Synthetic polynucleotide
tcatcgtaggacatcacatctctgtttttttt

SEQ ID NO: 9847 - DNA, 32 bp, Artificial Sequence
  Synthetic polynucleotide
ttttttttcaatggaggtgggcgcaaaccgtt

SEQ ID NO: 9848 - DNA, 32 bp, Artificial Sequence
  Synthetic polynucleotide
tacgcgggttttttttgtgggcgcaaaccgtt

SEQ ID NO: 9849 - DNA, 32 bp, Artificial Sequence
  Synthetic polynucleotide
tacgcgggcaatggagttttttttaaaccgtt

SEQ ID NO: 9850 - DNA, 32 bp, Artificial Sequence
  Synthetic polynucleotide
tacgcgggcaatggaggtgggcgctttttttt

SEQ ID NO: 9851 - DNA, 32 bp, Artificial Sequence
  Synthetic polynucleotide
ttttttttttaaacagttgaaggtttgaacca

SEQ ID NO: 9852 - DNA, 32 bp, Artificial Sequence
  Synthetic polynucleotide
ttcaacttttttttttttgaaggtttgaacca

SEQ ID NO: 9853 - DNA, 32 bp, Artificial Sequence
  Synthetic polynucleotide
ttcaacttttaaacagttttttttttgaacca

SEQ ID NO: 9854 - DNA, 32 bp, Artificial Sequence
  Synthetic polynucleotide
ttcaacttttaaacagttgaaggttttttttt

SEQ ID NO: 9855 - DNA, 32 bp, Artificial Sequence
  Synthetic polynucleotide
ttttttttttcccaggttattgagacctatct

SEQ ID NO: 9856 - DNA, 32 bp, Artificial Sequence
  Synthetic polynucleotide
ttccttgattttttttttattgagacctatct

SEQ ID NO: 9857 - DNA, 32 bp, Artificial Sequence
  Synthetic polynucleotide
ttccttgattcccaggttttttttacctatct

SEQ ID NO: 9858 - DNA, 32 bp, Artificial Sequence
  Synthetic polynucleotide
ttccttgattcccaggttattgagtttttttt

SEQ ID NO: 9859 - DNA, 32 bp, Artificial Sequence
  Synthetic polynucleotide
ttttttttctacagcaccgtgatgagacttcg

SEQ ID NO: 9860 - DNA, 32 bp, Artificial Sequence
  Synthetic polynucleotide
atcacgctttttttttccgtgatgagacttcg

SEQ ID NO: 9861 - DNA, 32 bp, Artificial Sequence
  Synthetic polynucleotide
atcacgctctacagcattttttttagacttcg

SEQ ID NO: 9862 - DNA, 32 bp, Artificial Sequence
  Synthetic polynucleotide
atcacgctctacagcaccgtgatgtttttttt

SEQ ID NO: 9863 - DNA, 32 bp, Artificial Sequence
  Synthetic polynucleotide
ttttttttacgcctgcttccgtggccccgcaa

SEQ ID NO: 9864 - DNA, 32 bp, Artificial Sequence
  Synthetic polynucleotide
tgcgttcgttttttttttccgtggccccgcaa

SEQ ID NO: 9865 - DNA, 32 bp, Artificial Sequence
  Synthetic polynucleotide
tgcgttcgacgcctgcttttttttccccgcaa

SEQ ID NO: 9866 - DNA, 32 bp, Artificial Sequence
  Synthetic polynucleotide
tgcgttcgacgcctgcttccgtggtttttttt

SEQ ID NO: 9867 - DNA, 32 bp, Artificial Sequence
  Synthetic polynucleotide
ttttttttctgagggggaggggatagcatacc

SEQ ID NO: 9868 - DNA, 32 bp, Artificial Sequence
  Synthetic polynucleotide
ccgcatcgttttttttgaggggatagcatacc

SEQ ID NO: 9869 - DNA, 32 bp, Artificial Sequence
  Synthetic polynucleotide
ccgcatcgctgaggggttttttttagcatacc

SEQ ID NO: 9870 - DNA, 32 bp, Artificial Sequence
  Synthetic polynucleotide
ccgcatcgctgagggggaggggattttttttt

SEQ ID NO: 9871 - DNA, 32 bp, Artificial Sequence
  Synthetic polynucleotide
ttttttttaccctcgcgggtgatcggccgtta

SEQ ID NO: 9872 - DNA, 32 bp, Artificial Sequence
  Synthetic polynucleotide
cagcacaattttttttgggtgatcggccgtta

SEQ ID NO: 9873 - DNA, 32 bp, Artificial Sequence
  Synthetic polynucleotide
cagcacaaaccctcgcttttttttggccgtta

SEQ ID NO: 9874 - DNA, 32 bp, Artificial Sequence
  Synthetic polynucleotide
cagcacaaaccctcgcgggtgatctttttttt

SEQ ID NO: 9875 - DNA, 32 bp, Artificial Sequence
  Synthetic polynucleotide
ttttttttgtgctgtgttctatcgatctcctt

SEQ ID NO: 9876 - DNA, 32 bp, Artificial Sequence
  Synthetic polynucleotide
gtcgtaatttttttttttctatcgatctcctt

SEQ ID NO: 9877 - DNA, 32 bp, Artificial Sequence
  Synthetic polynucleotide
gtcgtaatgtgctgtgttttttttatctcctt

SEQ ID NO: 9878 - DNA, 32 bp, Artificial Sequence
  Synthetic polynucleotide
gtcgtaatgtgctgtgttctatcgtttttttt

SEQ ID NO: 9879 - DNA, 32 bp, Artificial Sequence
  Synthetic polynucleotide
ttttttttaatgcaaaaccatgttgaaattgt

SEQ ID NO: 9880 - DNA, 32 bp, Artificial Sequence
  Synthetic polynucleotide
cgcaacaattttttttaccatgttgaaattgt

SEQ ID NO: 9881 - DNA, 32 bp, Artificial Sequence
  Synthetic polynucleotide
cgcaacaaaatgcaaattttttttgaaattgt

SEQ ID NO: 9882 - DNA, 32 bp, Artificial Sequence
  Synthetic polynucleotide
cgcaacaaaatgcaaaaccatgtttttttttt

SEQ ID NO: 9883 - DNA, 32 bp, Artificial Sequence
  Synthetic polynucleotide
ttttttttcacgaggcacacggcgtcagcgat

SEQ ID NO: 9884 - DNA, 32 bp, Artificial Sequence
  Synthetic polynucleotide
gctgccgattttttttacacggcgtcagcgat

SEQ ID NO: 9885 - DNA, 32 bp, Artificial Sequence
  Synthetic polynucleotide
gctgccgacacgaggctttttttttcagcgat

SEQ ID NO: 9886 - DNA, 32 bp, Artificial Sequence
  Synthetic polynucleotide
gctgccgacacgaggcacacggcgtttttttt

SEQ ID NO: 9887 - DNA, 32 bp, Artificial Sequence
  Synthetic polynucleotide
ttttttttcctagcaataagacaagtagaaca

SEQ ID NO: 9888 - DNA, 32 bp, Artificial Sequence
  Synthetic polynucleotide
cgcatctatttttttttaagacaagtagaaca

SEQ ID NO: 9889 - DNA, 32 bp, Artificial Sequence
  Synthetic polynucleotide
cgcatctacctagcaattttttttgtagaaca

SEQ ID NO: 9890 - DNA, 32 bp, Artificial Sequence
  Synthetic polynucleotide
cgcatctacctagcaataagacaatttttttt

SEQ ID NO: 9891 - DNA, 32 bp, Artificial Sequence
  Synthetic polynucleotide
ttttttttggtgtagtggattcatttaactac

SEQ ID NO: 9892 - DNA, 32 bp, Artificial Sequence
  Synthetic polynucleotide
ttgtgttgttttttttggattcatttaactac

SEQ ID NO: 9893 - DNA, 32 bp, Artificial Sequence
  Synthetic polynucleotide
ttgtgttgggtgtagtttttttttttaactac

SEQ ID NO: 9894 - DNA, 32 bp, Artificial Sequence
  Synthetic polynucleotide
ttgtgttgggtgtagtggattcattttttttt

SEQ ID NO: 9895 - DNA, 32 bp, Artificial Sequence
  Synthetic polynucleotide
ttttttttttacctaataccatgaggagcagg

SEQ ID NO: 9896 - DNA, 32 bp, Artificial Sequence
  Synthetic polynucleotide
cgatgttatttttttttaccatgaggagcagg

SEQ ID NO: 9897 - DNA, 32 bp, Artificial Sequence
  Synthetic polynucleotide
cgatgttattacctaattttttttggagcagg

SEQ ID NO: 9898 - DNA, 32 bp, Artificial Sequence
  Synthetic polynucleotide
cgatgttattacctaataccatgatttttttt

SEQ ID NO: 9899 - DNA, 32 bp, Artificial Sequence
  Synthetic polynucleotide
ttttttttaatacatttatgaatccagacacg

SEQ ID NO: 9900 - DNA, 32 bp, Artificial Sequence
  Synthetic polynucleotide
gattgacttttttttttatgaatccagacacg

SEQ ID NO: 9901 - DNA, 32 bp, Artificial Sequence
  Synthetic polynucleotide
gattgactaatacattttttttttcagacacg

SEQ ID NO: 9902 - DNA, 32 bp, Artificial Sequence
  Synthetic polynucleotide
gattgactaatacatttatgaatctttttttt

SEQ ID NO: 9903 - DNA, 32 bp, Artificial Sequence
  Synthetic polynucleotide
tttttttttccggggagtagtctgtagggtga

SEQ ID NO: 9904 - DNA, 32 bp, Artificial Sequence
  Synthetic polynucleotide
aggtacacttttttttgtagtctgtagggtga

SEQ ID NO: 9905 - DNA, 32 bp, Artificial Sequence
  Synthetic polynucleotide
aggtacactccggggatttttttttagggtga

SEQ ID NO: 9906 - DNA, 32 bp, Artificial Sequence
  Synthetic polynucleotide
aggtacactccggggagtagtctgtttttttt

SEQ ID NO: 9907 - DNA, 32 bp, Artificial Sequence
  Synthetic polynucleotide
ttttttttgcaagctcgtcaagtggtatagcc

SEQ ID NO: 9908 - DNA, 32 bp, Artificial Sequence
  Synthetic polynucleotide
tatacccgttttttttgtcaagtggtatagcc

SEQ ID NO: 9909 - DNA, 32 bp, Artificial Sequence
  Synthetic polynucleotide
tatacccggcaagctcttttttttgtatagcc

SEQ ID NO: 9910 - DNA, 32 bp, Artificial Sequence
  Synthetic polynucleotide
tatacccggcaagctcgtcaagtgtttttttt

SEQ ID NO: 9911 - DNA, 32 bp, Artificial Sequence
  Synthetic polynucleotide
tttttttttacgctccaaatactgcccacggt

SEQ ID NO: 9912 - DNA, 32 bp, Artificial Sequence
  Synthetic polynucleotide
cgcagcacttttttttaaatactgcccacggt

SEQ ID NO: 9913 - DNA, 32 bp, Artificial Sequence
  Synthetic polynucleotide
cgcagcactacgctccttttttttcccacggt

SEQ ID NO: 9914 - DNA, 32 bp, Artificial Sequence
  Synthetic polynucleotide
cgcagcactacgctccaaatactgtttttttt

SEQ ID NO: 9915 - DNA, 32 bp, Artificial Sequence
  Synthetic polynucleotide
ttttttttctccataaaggcgtctcaggaagt

SEQ ID NO: 9916 - DNA, 32 bp, Artificial Sequence
  Synthetic polynucleotide
attaggcattttttttaggcgtctcaggaagt

SEQ ID NO: 9917 - DNA, 32 bp, Artificial Sequence
  Synthetic polynucleotide
attaggcactccataattttttttcaggaagt

SEQ ID NO: 9918 - DNA, 32 bp, Artificial Sequence
  Synthetic polynucleotide
attaggcactccataaaggcgtcttttttttt

SEQ ID NO: 9919 - DNA, 32 bp, Artificial Sequence
  Synthetic polynucleotide
ttttttttctcgacaataccctccctctgcgg

SEQ ID NO: 9920 - DNA, 32 bp, Artificial Sequence
  Synthetic polynucleotide
gttttgtgtttttttttaccctccctctgcgg

SEQ ID NO: 9921 - DNA, 32 bp, Artificial Sequence
  Synthetic polynucleotide
gttttgtgctcgacaattttttttctctgcgg

SEQ ID NO: 9922 - DNA, 32 bp, Artificial Sequence
  Synthetic polynucleotide
gttttgtgctcgacaataccctcctttttttt

SEQ ID NO: 9923 - DNA, 32 bp, Artificial Sequence
  Synthetic polynucleotide
ttttttttcattggcactataagactactcca

SEQ ID NO: 9924 - DNA, 32 bp, Artificial Sequence
  Synthetic polynucleotide
cgcgaccattttttttctataagactactcca

SEQ ID NO: 9925 - DNA, 32 bp, Artificial Sequence
  Synthetic polynucleotide
cgcgaccacattggcattttttttctactcca

SEQ ID NO: 9926 - DNA, 32 bp, Artificial Sequence
  Synthetic polynucleotide
cgcgaccacattggcactataagatttttttt

SEQ ID NO: 9927 - DNA, 32 bp, Artificial Sequence
  Synthetic polynucleotide
ttttttttttgaccgatccagagctaagaaaa

SEQ ID NO: 9928 - DNA, 32 bp, Artificial Sequence
  Synthetic polynucleotide
accacctgtttttttttccagagctaagaaaa

SEQ ID NO: 9929 - DNA, 32 bp, Artificial Sequence
  Synthetic polynucleotide
accacctgttgaccgatttttttttaagaaaa

SEQ ID NO: 9930 - DNA, 32 bp, Artificial Sequence
  Synthetic polynucleotide
accacctgttgaccgatccagagctttttttt

SEQ ID NO: 9931 - DNA, 32 bp, Artificial Sequence
  Synthetic polynucleotide
tttttttttatcagaggtcgtaactcggtcgc

SEQ ID NO: 9932 - DNA, 32 bp, Artificial Sequence
  Synthetic polynucleotide
cctcgtgattttttttgtcgtaactcggtcgc

SEQ ID NO: 9933 - DNA, 32 bp, Artificial Sequence
  Synthetic polynucleotide
cctcgtgatatcagagtttttttttcggtcgc

SEQ ID NO: 9934 - DNA, 32 bp, Artificial Sequence
  Synthetic polynucleotide
cctcgtgatatcagaggtcgtaactttttttt

SEQ ID NO: 9935 - DNA, 32 bp, Artificial Sequence
  Synthetic polynucleotide
ttttttttttggctcaaaacgtctagtatttc

SEQ ID NO: 9936 - DNA, 32 bp, Artificial Sequence
  Synthetic polynucleotide
ggtatgcattttttttaaacgtctagtatttc

SEQ ID NO: 9937 - DNA, 32 bp, Artificial Sequence
  Synthetic polynucleotide
ggtatgcattggctcattttttttagtatttc

SEQ ID NO: 9938 - DNA, 32 bp, Artificial Sequence
  Synthetic polynucleotide
ggtatgcattggctcaaaacgtcttttttttt

SEQ ID NO: 9939 - DNA, 32 bp, Artificial Sequence
  Synthetic polynucleotide
ttttttttgcgtgaggtatgggcctcatcccc

SEQ ID NO: 9940 - DNA, 32 bp, Artificial Sequence
  Synthetic polynucleotide
tagactcatttttttttatgggcctcatcccc

SEQ ID NO: 9941 - DNA, 32 bp, Artificial Sequence
  Synthetic polynucleotide
tagactcagcgtgaggtttttttttcatcccc

SEQ ID NO: 9942 - DNA, 32 bp, Artificial Sequence
  Synthetic polynucleotide
tagactcagcgtgaggtatgggcctttttttt

SEQ ID NO: 9943 - DNA, 32 bp, Artificial Sequence
  Synthetic polynucleotide
ttttttttcatgtatgtactcatcagcaccta

SEQ ID NO: 9944 - DNA, 32 bp, Artificial Sequence
  Synthetic polynucleotide
tgacgcagtttttttttactcatcagcaccta

SEQ ID NO: 9945 - DNA, 32 bp, Artificial Sequence
  Synthetic polynucleotide
tgacgcagcatgtatgttttttttagcaccta

SEQ ID NO: 9946 - DNA, 32 bp, Artificial Sequence
  Synthetic polynucleotide
tgacgcagcatgtatgtactcatctttttttt

SEQ ID NO: 9947 - DNA, 32 bp, Artificial Sequence
  Synthetic polynucleotide
ttttttttccatccctcgagggtttgtttcac

SEQ ID NO: 9948 - DNA, 32 bp, Artificial Sequence
  Synthetic polynucleotide
taacctggttttttttcgagggtttgtttcac

SEQ ID NO: 9949 - DNA, 32 bp, Artificial Sequence
  Synthetic polynucleotide
taacctggccatcccttttttttttgtttcac

SEQ ID NO: 9950 - DNA, 32 bp, Artificial Sequence
  Synthetic polynucleotide
taacctggccatccctcgagggtttttttttt

SEQ ID NO: 9951 - DNA, 32 bp, Artificial Sequence
  Synthetic polynucleotide
tttttttttccggtttgggcactcgtataacc

SEQ ID NO: 9952 - DNA, 32 bp, Artificial Sequence
  Synthetic polynucleotide
gtatgattttttttttgggcactcgtataacc

SEQ ID NO: 9953 - DNA, 32 bp, Artificial Sequence
  Synthetic polynucleotide
gtatgatttccggtttttttttttgtataacc

SEQ ID NO: 9954 - DNA, 32 bp, Artificial Sequence
  Synthetic polynucleotide
gtatgatttccggtttgggcactctttttttt

SEQ ID NO: 9955 - DNA, 32 bp, Artificial Sequence
  Synthetic polynucleotide
ttttttttgcggccatgttatttctatttcga

SEQ ID NO: 9956 - DNA, 32 bp, Artificial Sequence
  Synthetic polynucleotide
acccgagcttttttttgttatttctatttcga

SEQ ID NO: 9957 - DNA, 32 bp, Artificial Sequence
  Synthetic polynucleotide
acccgagcgcggccattttttttttatttcga

SEQ ID NO: 9958 - DNA, 32 bp, Artificial Sequence
  Synthetic polynucleotide
acccgagcgcggccatgttatttctttttttt

SEQ ID NO: 9959 - DNA, 32 bp, Artificial Sequence
  Synthetic polynucleotide
ttttttttcgctcagccggaacagccaaggca

SEQ ID NO: 9960 - DNA, 32 bp, Artificial Sequence
  Synthetic polynucleotide
cactgagtttttttttcggaacagccaaggca

SEQ ID NO: 9961 - DNA, 32 bp, Artificial Sequence
  Synthetic polynucleotide
cactgagtcgctcagcttttttttccaaggca

SEQ ID NO: 9962 - DNA, 32 bp, Artificial Sequence
  Synthetic polynucleotide
cactgagtcgctcagccggaacagtttttttt

SEQ ID NO: 9963 - DNA, 32 bp, Artificial Sequence
  Synthetic polynucleotide
ttttttttacagctaagaacttgaatcatggt

SEQ ID NO: 9964 - DNA, 32 bp, Artificial Sequence
  Synthetic polynucleotide
acaggcggttttttttgaacttgaatcatggt

SEQ ID NO: 9965 - DNA, 32 bp, Artificial Sequence
  Synthetic polynucleotide
acaggcggacagctaattttttttatcatggt

SEQ ID NO: 9966 - DNA, 32 bp, Artificial Sequence
  Synthetic polynucleotide
acaggcggacagctaagaacttgatttttttt

SEQ ID NO: 9967 - DNA, 32 bp, Artificial Sequence
  Synthetic polynucleotide
ttttttttttccagcttgacgatccgcagggt

SEQ ID NO: 9968 - DNA, 32 bp, Artificial Sequence
  Synthetic polynucleotide
tcagaaactttttttttgacgatccgcagggt

SEQ ID NO: 9969 - DNA, 32 bp, Artificial Sequence
  Synthetic polynucleotide
tcagaaacttccagctttttttttcgcagggt

SEQ ID NO: 9970 - DNA, 32 bp, Artificial Sequence
  Synthetic polynucleotide
tcagaaacttccagcttgacgatctttttttt

SEQ ID NO: 9971 - DNA, 32 bp, Artificial Sequence
  Synthetic polynucleotide
tttttttttgcgatcattagtgaggtttcctt

SEQ ID NO: 9972 - DNA, 32 bp, Artificial Sequence
  Synthetic polynucleotide
gagggaacttttttttttagtgaggtttcctt

SEQ ID NO: 9973 - DNA, 32 bp, Artificial Sequence
  Synthetic polynucleotide
gagggaactgcgatcattttttttgtttcctt

SEQ ID NO: 9974 - DNA, 32 bp, Artificial Sequence
  Synthetic polynucleotide
gagggaactgcgatcattagtgagtttttttt

SEQ ID NO: 9975 - DNA, 32 bp, Artificial Sequence
  Synthetic polynucleotide
ttttttttagttttggcttacatcgcccccta

SEQ ID NO: 9976 - DNA, 32 bp, Artificial Sequence
  Synthetic polynucleotide
ccaggtcattttttttcttacatcgcccccta

SEQ ID NO: 9977 - DNA, 32 bp, Artificial Sequence
  Synthetic polynucleotide
ccaggtcaagttttggttttttttgcccccta

SEQ ID NO: 9978 - DNA, 32 bp, Artificial Sequence
  Synthetic polynucleotide
ccaggtcaagttttggcttacatctttttttt

SEQ ID NO: 9979 - DNA, 32 bp, Artificial Sequence
  Synthetic polynucleotide
tttttttttcagtcgtcgagtcgtaacctcgt

SEQ ID NO: 9980 - DNA, 32 bp, Artificial Sequence
  Synthetic polynucleotide
agatgttcttttttttcgagtcgtaacctcgt

SEQ ID NO: 9981 - DNA, 32 bp, Artificial Sequence
  Synthetic polynucleotide
agatgttctcagtcgtttttttttaacctcgt

SEQ ID NO: 9982 - DNA, 32 bp, Artificial Sequence
  Synthetic polynucleotide
agatgttctcagtcgtcgagtcgttttttttt

SEQ ID NO: 9983 - DNA, 32 bp, Artificial Sequence
  Synthetic polynucleotide
ttttttttttaatttgagtttcctcagaagtg

SEQ ID NO: 9984 - DNA, 32 bp, Artificial Sequence
  Synthetic polynucleotide
ataatagtttttttttagtttcctcagaagtg

SEQ ID NO: 9985 - DNA, 32 bp, Artificial Sequence
  Synthetic polynucleotide
ataatagtttaatttgttttttttcagaagtg

SEQ ID NO: 9986 - DNA, 32 bp, Artificial Sequence
  Synthetic polynucleotide
ataatagtttaatttgagtttccttttttttt

SEQ ID NO: 9987 - DNA, 32 bp, Artificial Sequence
  Synthetic polynucleotide
ttttttttccaaggagggaatgcaacaccggc

SEQ ID NO: 9988 - DNA, 32 bp, Artificial Sequence
  Synthetic polynucleotide
cccagtgattttttttggaatgcaacaccggc

SEQ ID NO: 9989 - DNA, 32 bp, Artificial Sequence
  Synthetic polynucleotide
cccagtgaccaaggagttttttttacaccggc

SEQ ID NO: 9990 - DNA, 32 bp, Artificial Sequence
  Synthetic polynucleotide
cccagtgaccaaggagggaatgcatttttttt

SEQ ID NO: 9991 - DNA, 32 bp, Artificial Sequence
  Synthetic polynucleotide
ttttttttgtatagcgctcgacggaggatatg

SEQ ID NO: 9992 - DNA, 32 bp, Artificial Sequence
  Synthetic polynucleotide
ctaatatattttttttctcgacggaggatatg

SEQ ID NO: 9993 - DNA, 32 bp, Artificial Sequence
  Synthetic polynucleotide
ctaatatagtatagcgttttttttaggatatg

SEQ ID NO: 9994 - DNA, 32 bp, Artificial Sequence
  Synthetic polynucleotide
ctaatatagtatagcgctcgacggtttttttt

SEQ ID NO: 9995 - DNA, 32 bp, Artificial Sequence
  Synthetic polynucleotide
tttttttttgggtaagatgtggttccattacg

SEQ ID NO: 9996 - DNA, 32 bp, Artificial Sequence
  Synthetic polynucleotide
tctttctcttttttttatgtggttccattacg

SEQ ID NO: 9997 - DNA, 32 bp, Artificial Sequence
  Synthetic polynucleotide
tctttctctgggtaagttttttttccattacg

SEQ ID NO: 9998 - DNA, 32 bp, Artificial Sequence
  Synthetic polynucleotide
tctttctctgggtaagatgtggtttttttttt

SEQ ID NO: 9999 - DNA, 32 bp, Artificial Sequence
  Synthetic polynucleotide
ttttttttccaccgcaatcgactaggaaggac

SEQ ID NO: 10000 - DNA, 32 bp, Artificial Sequence
  Synthetic polynucleotide
cacgcgagttttttttatcgactaggaaggac

SEQ ID NO: 10001 - DNA, 32 bp, Artificial Sequence
  Synthetic polynucleotide
cacgcgagccaccgcattttttttggaaggac

SEQ ID NO: 10002 - DNA, 32 bp, Artificial Sequence
  Synthetic polynucleotide
cacgcgagccaccgcaatcgactatttttttt

SEQ ID NO: 10003 - DNA, 32 bp, Artificial Sequence
  Synthetic polynucleotide
ttttttttctatgtagatctggtcattgaaag

SEQ ID NO: 10004 - DNA, 32 bp, Artificial Sequence
  Synthetic polynucleotide
gatagctgttttttttatctggtcattgaaag

SEQ ID NO: 10005 - DNA, 32 bp, Artificial Sequence
  Synthetic polynucleotide
gatagctgctatgtagttttttttattgaaag

SEQ ID NO: 10006 - DNA, 32 bp, Artificial Sequence
  Synthetic polynucleotide
gatagctgctatgtagatctggtctttttttt

SEQ ID NO: 10007 - DNA, 32 bp, Artificial Sequence
  Synthetic polynucleotide
ttttttttgaatatggaaagactgtgcgagat

SEQ ID NO: 10008 - DNA, 32 bp, Artificial Sequence
  Synthetic polynucleotide
gacagggattttttttaaagactgtgcgagat

SEQ ID NO: 10009 - DNA, 32 bp, Artificial Sequence
  Synthetic polynucleotide
gacagggagaatatggtttttttttgcgagat

SEQ ID NO: 10010 - DNA, 32 bp, Artificial Sequence
  Synthetic polynucleotide
gacagggagaatatggaaagactgtttttttt

SEQ ID NO: 10011 - DNA, 32 bp, Artificial Sequence
  Synthetic polynucleotide
ttttttttgctcgacaagctctgttcctatga

SEQ ID NO: 10012 - DNA, 32 bp, Artificial Sequence
  Synthetic polynucleotide
ggtcagaattttttttagctctgttcctatga

SEQ ID NO: 10013 - DNA, 32 bp, Artificial Sequence
  Synthetic polynucleotide
ggtcagaagctcgacatttttttttcctatga

SEQ ID NO: 10014 - DNA, 32 bp, Artificial Sequence
  Synthetic polynucleotide
ggtcagaagctcgacaagctctgttttttttt

SEQ ID NO: 10015 - DNA, 32 bp, Artificial Sequence
  Synthetic polynucleotide
tttttttttgagctttgagtcggcctgacaga

SEQ ID NO: 10016 - DNA, 32 bp, Artificial Sequence
  Synthetic polynucleotide
cccccaagttttttttgagtcggcctgacaga

SEQ ID NO: 10017 - DNA, 32 bp, Artificial Sequence
  Synthetic polynucleotide
cccccaagtgagctttttttttttctgacaga

SEQ ID NO: 10018 - DNA, 32 bp, Artificial Sequence
  Synthetic polynucleotide
cccccaagtgagctttgagtcggctttttttt

SEQ ID NO: 10019 - DNA, 32 bp, Artificial Sequence
  Synthetic polynucleotide
ttttttttacgcttagcgcccactctatgaac

SEQ ID NO: 10020 - DNA, 32 bp, Artificial Sequence
  Synthetic polynucleotide
tcatccggttttttttcgcccactctatgaac

SEQ ID NO: 10021 - DNA, 32 bp, Artificial Sequence
  Synthetic polynucleotide
tcatccggacgcttagttttttttctatgaac

SEQ ID NO: 10022 - DNA, 32 bp, Artificial Sequence
  Synthetic polynucleotide
tcatccggacgcttagcgcccacttttttttt

SEQ ID NO: 10023 - DNA, 32 bp, Artificial Sequence
  Synthetic polynucleotide
ttttttttttcataacacactgacaccctttt

SEQ ID NO: 10024 - DNA, 32 bp, Artificial Sequence
  Synthetic polynucleotide
ggcgcatattttttttacactgacaccctttt

SEQ ID NO: 10025 - DNA, 32 bp, Artificial Sequence
  Synthetic polynucleotide
ggcgcatattcataacttttttttaccctttt

SEQ ID NO: 10026 - DNA, 32 bp, Artificial Sequence
  Synthetic polynucleotide
ggcgcatattcataacacactgactttttttt

SEQ ID NO: 10027 - DNA, 32 bp, Artificial Sequence
  Synthetic polynucleotide
ttttttttggatatcgcagcccattacccaca

SEQ ID NO: 10028 - DNA, 32 bp, Artificial Sequence
  Synthetic polynucleotide
cctatcttttttttttcagcccattacccaca

SEQ ID NO: 10029 - DNA, 32 bp, Artificial Sequence
  Synthetic polynucleotide
cctatcttggatatcgtttttttttacccaca

SEQ ID NO: 10030 - DNA, 32 bp, Artificial Sequence
  Synthetic polynucleotide
cctatcttggatatcgcagcccattttttttt

SEQ ID NO: 10031 - DNA, 32 bp, Artificial Sequence
  Synthetic polynucleotide
ttttttttgctgtgaccagagccgaggtcagg

SEQ ID NO: 10032 - DNA, 32 bp, Artificial Sequence
  Synthetic polynucleotide
agctgttcttttttttcagagccgaggtcagg

SEQ ID NO: 10033 - DNA, 32 bp, Artificial Sequence
  Synthetic polynucleotide
agctgttcgctgtgacttttttttaggtcagg

SEQ ID NO: 10034 - DNA, 32 bp, Artificial Sequence
  Synthetic polynucleotide
agctgttcgctgtgaccagagccgtttttttt

SEQ ID NO: 10035 - DNA, 32 bp, Artificial Sequence
  Synthetic polynucleotide
tttttttttccccgtctccaaaccaaattgtg

SEQ ID NO: 10036 - DNA, 32 bp, Artificial Sequence
  Synthetic polynucleotide
ctaacgattttttttttccaaaccaaattgtg

SEQ ID NO: 10037 - DNA, 32 bp, Artificial Sequence
  Synthetic polynucleotide
ctaacgattccccgtcttttttttaaattgtg

SEQ ID NO: 10038 - DNA, 32 bp, Artificial Sequence
  Synthetic polynucleotide
ctaacgattccccgtctccaaacctttttttt

SEQ ID NO: 10039 - DNA, 32 bp, Artificial Sequence
  Synthetic polynucleotide
tttttttttcgagaaagcaccgaaaaaagccc

SEQ ID NO: 10040 - DNA, 32 bp, Artificial Sequence
  Synthetic polynucleotide
agattgtattttttttgcaccgaaaaaagccc

SEQ ID NO: 10041 - DNA, 32 bp, Artificial Sequence
  Synthetic polynucleotide
agattgtatcgagaaattttttttaaaagccc

SEQ ID NO: 10042 - DNA, 32 bp, Artificial Sequence
  Synthetic polynucleotide
agattgtatcgagaaagcaccgaatttttttt

SEQ ID NO: 10043 - DNA, 32 bp, Artificial Sequence
  Synthetic polynucleotide
ttttttttttacttcgtgcccatggtgacacg

SEQ ID NO: 10044 - DNA, 32 bp, Artificial Sequence
  Synthetic polynucleotide
atcagttatttttttttgcccatggtgacacg

SEQ ID NO: 10045 - DNA, 32 bp, Artificial Sequence
  Synthetic polynucleotide
atcagttattacttcgttttttttgtgacacg

SEQ ID NO: 10046 - DNA, 32 bp, Artificial Sequence
  Synthetic polynucleotide
atcagttattacttcgtgcccatgtttttttt

SEQ ID NO: 10047 - DNA, 32 bp, Artificial Sequence
  Synthetic polynucleotide
ttttttttaggagaaaaacagcatggcttcat

SEQ ID NO: 10048 - DNA, 32 bp, Artificial Sequence
  Synthetic polynucleotide
gtccaacattttttttaacagcatggcttcat

SEQ ID NO: 10049 - DNA, 32 bp, Artificial Sequence
  Synthetic polynucleotide
gtccaacaaggagaaattttttttggcttcat

SEQ ID NO: 10050 - DNA, 32 bp, Artificial Sequence
  Synthetic polynucleotide
gtccaacaaggagaaaaacagcattttttttt

SEQ ID NO: 10051 - DNA, 32 bp, Artificial Sequence
  Synthetic polynucleotide
tttttttttgataatctcccacgtacaacata

SEQ ID NO: 10052 - DNA, 32 bp, Artificial Sequence
  Synthetic polynucleotide
aggtggcctttttttttcccacgtacaacata

SEQ ID NO: 10053 - DNA, 32 bp, Artificial Sequence
  Synthetic polynucleotide
aggtggcctgataatcttttttttacaacata

SEQ ID NO: 10054 - DNA, 32 bp, Artificial Sequence
  Synthetic polynucleotide
aggtggcctgataatctcccacgttttttttt

SEQ ID NO: 10055 - DNA, 32 bp, Artificial Sequence
  Synthetic polynucleotide
ttttttttcccgagccagttcgtatatgctct

SEQ ID NO: 10056 - DNA, 32 bp, Artificial Sequence
  Synthetic polynucleotide
ctaccgctttttttttagttcgtatatgctct

SEQ ID NO: 10057 - DNA, 32 bp, Artificial Sequence
  Synthetic polynucleotide
ctaccgctcccgagcctttttttttatgctct

SEQ ID NO: 10058 - DNA, 32 bp, Artificial Sequence
  Synthetic polynucleotide
ctaccgctcccgagccagttcgtatttttttt

SEQ ID NO: 10059 - DNA, 32 bp, Artificial Sequence
  Synthetic polynucleotide
ttttttttgtgggaggtaattagtacggccac

SEQ ID NO: 10060 - DNA, 32 bp, Artificial Sequence
  Synthetic polynucleotide
cttgacgatttttttttaattagtacggccac

SEQ ID NO: 10061 - DNA, 32 bp, Artificial Sequence
  Synthetic polynucleotide
cttgacgagtgggaggttttttttacggccac

SEQ ID NO: 10062 - DNA, 32 bp, Artificial Sequence
  Synthetic polynucleotide
cttgacgagtgggaggtaattagttttttttt

SEQ ID NO: 10063 - DNA, 32 bp, Artificial Sequence
  Synthetic polynucleotide
ttttttttaaagcagggatactttgaaaaggc

SEQ ID NO: 10064 - DNA, 32 bp, Artificial Sequence
  Synthetic polynucleotide
gaccatagttttttttgatactttgaaaaggc

SEQ ID NO: 10065 - DNA, 32 bp, Artificial Sequence
  Synthetic polynucleotide
gaccatagaaagcaggttttttttgaaaaggc

SEQ ID NO: 10066 - DNA, 32 bp, Artificial Sequence
  Synthetic polynucleotide
gaccatagaaagcagggatacttttttttttt

SEQ ID NO: 10067 - DNA, 32 bp, Artificial Sequence
  Synthetic polynucleotide
ttttttttaccataccaacggcgaataaaagc

SEQ ID NO: 10068 - DNA, 32 bp, Artificial Sequence
  Synthetic polynucleotide
aatgcacattttttttaacggcgaataaaagc

SEQ ID NO: 10069 - DNA, 32 bp, Artificial Sequence
  Synthetic polynucleotide
aatgcacaaccataccttttttttataaaagc

SEQ ID NO: 10070 - DNA, 32 bp, Artificial Sequence
  Synthetic polynucleotide
aatgcacaaccataccaacggcgatttttttt

SEQ ID NO: 10071 - DNA, 32 bp, Artificial Sequence
  Synthetic polynucleotide
tttttttttcacgtggcctctccctgccgagg

SEQ ID NO: 10072 - DNA, 32 bp, Artificial Sequence
  Synthetic polynucleotide
cgtgcacattttttttcctctccctgccgagg

SEQ ID NO: 10073 - DNA, 32 bp, Artificial Sequence
  Synthetic polynucleotide
cgtgcacatcacgtggtttttttttgccgagg

SEQ ID NO: 10074 - DNA, 32 bp, Artificial Sequence
  Synthetic polynucleotide
cgtgcacatcacgtggcctctccctttttttt

SEQ ID NO: 10075 - DNA, 32 bp, Artificial Sequence
  Synthetic polynucleotide
ttttttttatccctgaacggggttggggcata

SEQ ID NO: 10076 - DNA, 32 bp, Artificial Sequence
  Synthetic polynucleotide
agtacgacttttttttacggggttggggcata

SEQ ID NO: 10077 - DNA, 32 bp, Artificial Sequence
  Synthetic polynucleotide
agtacgacatccctgattttttttggggcata

SEQ ID NO: 10078 - DNA, 32 bp, Artificial Sequence
  Synthetic polynucleotide
agtacgacatccctgaacggggtttttttttt

SEQ ID NO: 10079 - DNA, 32 bp, Artificial Sequence
  Synthetic polynucleotide
ttttttttttgctttagaggcggcatcgggtt

SEQ ID NO: 10080 - DNA, 32 bp, Artificial Sequence
  Synthetic polynucleotide
agtatagtttttttttgaggcggcatcgggtt

SEQ ID NO: 10081 - DNA, 32 bp, Artificial Sequence
  Synthetic polynucleotide
agtatagtttgctttattttttttatcgggtt

SEQ ID NO: 10082 - DNA, 32 bp, Artificial Sequence
  Synthetic polynucleotide
agtatagtttgctttagaggcggctttttttt

SEQ ID NO: 10083 - DNA, 32 bp, Artificial Sequence
  Synthetic polynucleotide
ttttttttgcaacctaggtaggttccgccgca

SEQ ID NO: 10084 - DNA, 32 bp, Artificial Sequence
  Synthetic polynucleotide
cacttgagttttttttggtaggttccgccgca

SEQ ID NO: 10085 - DNA, 32 bp, Artificial Sequence
  Synthetic polynucleotide
cacttgaggcaacctattttttttccgccgca

SEQ ID NO: 10086 - DNA, 32 bp, Artificial Sequence
  Synthetic polynucleotide
cacttgaggcaacctaggtaggtttttttttt

SEQ ID NO: 10087 - DNA, 32 bp, Artificial Sequence
  Synthetic polynucleotide
ttttttttactgttagggtacacggcctgttt

SEQ ID NO: 10088 - DNA, 32 bp, Artificial Sequence
  Synthetic polynucleotide
caggctacttttttttggtacacggcctgttt

SEQ ID NO: 10089 - DNA, 32 bp, Artificial Sequence
  Synthetic polynucleotide
caggctacactgttagttttttttgcctgttt

SEQ ID NO: 10090 - DNA, 32 bp, Artificial Sequence
  Synthetic polynucleotide
caggctacactgttagggtacacgtttttttt

SEQ ID NO: 10091 - DNA, 32 bp, Artificial Sequence
  Synthetic polynucleotide
ttttttttgcgcgccttcaaggcccgacatcc

SEQ ID NO: 10092 - DNA, 32 bp, Artificial Sequence
  Synthetic polynucleotide
atgtagcatttttttttcaaggcccgacatcc

SEQ ID NO: 10093 - DNA, 32 bp, Artificial Sequence
  Synthetic polynucleotide
atgtagcagcgcgcctttttttttcgacatcc

SEQ ID NO: 10094 - DNA, 32 bp, Artificial Sequence
  Synthetic polynucleotide
atgtagcagcgcgccttcaaggcctttttttt

SEQ ID NO: 10095 - DNA, 32 bp, Artificial Sequence
  Synthetic polynucleotide
ttttttttagaaactgtaggttaaatcagcta

SEQ ID NO: 10096 - DNA, 32 bp, Artificial Sequence
  Synthetic polynucleotide
tatggttttttttttttaggttaaatcagcta

SEQ ID NO: 10097 - DNA, 32 bp, Artificial Sequence
  Synthetic polynucleotide
tatggtttagaaactgttttttttatcagcta

SEQ ID NO: 10098 - DNA, 32 bp, Artificial Sequence
  Synthetic polynucleotide
tatggtttagaaactgtaggttaatttttttt

SEQ ID NO: 10099 - DNA, 32 bp, Artificial Sequence
  Synthetic polynucleotide
ttttttttggagcacttcgcaacgaggacgat

SEQ ID NO: 10100 - DNA, 32 bp, Artificial Sequence
  Synthetic polynucleotide
cgaatcaatttttttttcgcaacgaggacgat

SEQ ID NO: 10101 - DNA, 32 bp, Artificial Sequence
  Synthetic polynucleotide
cgaatcaaggagcactttttttttaggacgat

SEQ ID NO: 10102 - DNA, 32 bp, Artificial Sequence
  Synthetic polynucleotide
cgaatcaaggagcacttcgcaacgtttttttt

SEQ ID NO: 10103 - DNA, 32 bp, Artificial Sequence
  Synthetic polynucleotide
tttttttttatgtgatgtcgcatatatcccaa

SEQ ID NO: 10104 - DNA, 32 bp, Artificial Sequence
  Synthetic polynucleotide
actgtacgttttttttgtcgcatatatcccaa

SEQ ID NO: 10105 - DNA, 32 bp, Artificial Sequence
  Synthetic polynucleotide
actgtacgtatgtgattttttttttatcccaa

SEQ ID NO: 10106 - DNA, 32 bp, Artificial Sequence
  Synthetic polynucleotide
actgtacgtatgtgatgtcgcatatttttttt

SEQ ID NO: 10107 - DNA, 32 bp, Artificial Sequence
  Synthetic polynucleotide
ttttttttggttggttcggcatgcggtctaaa

SEQ ID NO: 10108 - DNA, 32 bp, Artificial Sequence
  Synthetic polynucleotide
atatcaagttttttttcggcatgcggtctaaa

SEQ ID NO: 10109 - DNA, 32 bp, Artificial Sequence
  Synthetic polynucleotide
atatcaagggttggttttttttttggtctaaa

SEQ ID NO: 10110 - DNA, 32 bp, Artificial Sequence
  Synthetic polynucleotide
atatcaagggttggttcggcatgctttttttt

SEQ ID NO: 10111 - DNA, 32 bp, Artificial Sequence
  Synthetic polynucleotide
ttttttttgtccctcagctatgctaggtagag

SEQ ID NO: 10112 - DNA, 32 bp, Artificial Sequence
  Synthetic polynucleotide
catatattttttttttgctatgctaggtagag

SEQ ID NO: 10113 - DNA, 32 bp, Artificial Sequence
  Synthetic polynucleotide
catatattgtccctcattttttttaggtagag

SEQ ID NO: 10114 - DNA, 32 bp, Artificial Sequence
  Synthetic polynucleotide
catatattgtccctcagctatgcttttttttt

SEQ ID NO: 10115 - DNA, 32 bp, Artificial Sequence
  Synthetic polynucleotide
ttttttttgaggatgtacttgggattaggatc

SEQ ID NO: 10116 - DNA, 32 bp, Artificial Sequence
  Synthetic polynucleotide
ctaatgaattttttttacttgggattaggatc

SEQ ID NO: 10117 - DNA, 32 bp, Artificial Sequence
  Synthetic polynucleotide
ctaatgaagaggatgtttttttttttaggatc

SEQ ID NO: 10118 - DNA, 32 bp, Artificial Sequence
  Synthetic polynucleotide
ctaatgaagaggatgtacttgggatttttttt

SEQ ID NO: 10119 - DNA, 32 bp, Artificial Sequence
  Synthetic polynucleotide
ttttttttttccgccctggagttagatgtccg

SEQ ID NO: 10120 - DNA, 32 bp, Artificial Sequence
  Synthetic polynucleotide
cgaccatgtttttttttggagttagatgtccg

SEQ ID NO: 10121 - DNA, 32 bp, Artificial Sequence
  Synthetic polynucleotide
cgaccatgttccgcccttttttttgatgtccg

SEQ ID NO: 10122 - DNA, 32 bp, Artificial Sequence
  Synthetic polynucleotide
cgaccatgttccgccctggagttatttttttt

SEQ ID NO: 10123 - DNA, 32 bp, Artificial Sequence
  Synthetic polynucleotide
ttttttttcagtagaaagcctacgtccgtgca

SEQ ID NO: 10124 - DNA, 32 bp, Artificial Sequence
  Synthetic polynucleotide
ctcggcccttttttttagcctacgtccgtgca

SEQ ID NO: 10125 - DNA, 32 bp, Artificial Sequence
  Synthetic polynucleotide
ctcggccccagtagaatttttttttccgtgca

SEQ ID NO: 10126 - DNA, 32 bp, Artificial Sequence
  Synthetic polynucleotide
ctcggccccagtagaaagcctacgtttttttt

SEQ ID NO: 10127 - DNA, 32 bp, Artificial Sequence
  Synthetic polynucleotide
ttttttttgcccagcggtttgaacctgtttac

SEQ ID NO: 10128 - DNA, 32 bp, Artificial Sequence
  Synthetic polynucleotide
aataaggattttttttgtttgaacctgtttac

SEQ ID NO: 10129 - DNA, 32 bp, Artificial Sequence
  Synthetic polynucleotide
aataaggagcccagcgttttttttctgtttac

SEQ ID NO: 10130 - DNA, 32 bp, Artificial Sequence
  Synthetic polynucleotide
aataaggagcccagcggtttgaactttttttt

SEQ ID NO: 10131 - DNA, 32 bp, Artificial Sequence
  Synthetic polynucleotide
tttttttttaagccacagagtatagatggccg

SEQ ID NO: 10132 - DNA, 32 bp, Artificial Sequence
  Synthetic polynucleotide
tactaaaattttttttagagtatagatggccg

SEQ ID NO: 10133 - DNA, 32 bp, Artificial Sequence
  Synthetic polynucleotide
tactaaaataagccacttttttttgatggccg

SEQ ID NO: 10134 - DNA, 32 bp, Artificial Sequence
  Synthetic polynucleotide
tactaaaataagccacagagtatatttttttt

SEQ ID NO: 10135 - DNA, 32 bp, Artificial Sequence
  Synthetic polynucleotide
tttttttttgggtgttccaagtcagcccctcg

SEQ ID NO: 10136 - DNA, 32 bp, Artificial Sequence
  Synthetic polynucleotide
ggaggcggttttttttccaagtcagcccctcg

SEQ ID NO: 10137 - DNA, 32 bp, Artificial Sequence
  Synthetic polynucleotide
ggaggcggtgggtgttttttttttgcccctcg

SEQ ID NO: 10138 - DNA, 32 bp, Artificial Sequence
  Synthetic polynucleotide
ggaggcggtgggtgttccaagtcatttttttt

SEQ ID NO: 10139 - DNA, 32 bp, Artificial Sequence
  Synthetic polynucleotide
tttttttttgactaccgattgccgtaaatggt

SEQ ID NO: 10140 - DNA, 32 bp, Artificial Sequence
  Synthetic polynucleotide
tagtttgattttttttgattgccgtaaatggt

SEQ ID NO: 10141 - DNA, 32 bp, Artificial Sequence
  Synthetic polynucleotide
tagtttgatgactacctttttttttaaatggt

SEQ ID NO: 10142 - DNA, 32 bp, Artificial Sequence
  Synthetic polynucleotide
tagtttgatgactaccgattgccgtttttttt

SEQ ID NO: 10143 - DNA, 32 bp, Artificial Sequence
  Synthetic polynucleotide
ttttttttgctgtattgtcgctggctaatcac

SEQ ID NO: 10144 - DNA, 32 bp, Artificial Sequence
  Synthetic polynucleotide
tttttgtcttttttttgtcgctggctaatcac

SEQ ID NO: 10145 - DNA, 32 bp, Artificial Sequence
  Synthetic polynucleotide
tttttgtcgctgtattttttttttctaatcac

SEQ ID NO: 10146 - DNA, 32 bp, Artificial Sequence
  Synthetic polynucleotide
tttttgtcgctgtattgtcgctggtttttttt

SEQ ID NO: 10147 - DNA, 32 bp, Artificial Sequence
  Synthetic polynucleotide
ttttttttgctgttcaacactaatccgggtat

SEQ ID NO: 10148 - DNA, 32 bp, Artificial Sequence
  Synthetic polynucleotide
tagtccacttttttttacactaatccgggtat

SEQ ID NO: 10149 - DNA, 32 bp, Artificial Sequence
  Synthetic polynucleotide
tagtccacgctgttcattttttttccgggtat

SEQ ID NO: 10150 - DNA, 32 bp, Artificial Sequence
  Synthetic polynucleotide
tagtccacgctgttcaacactaattttttttt

SEQ ID NO: 10151 - DNA, 32 bp, Artificial Sequence
  Synthetic polynucleotide
ttttttttgcgctttccgtcttaaacgacttt

SEQ ID NO: 10152 - DNA, 32 bp, Artificial Sequence
  Synthetic polynucleotide
ccgcacgtttttttttcgtcttaaacgacttt

SEQ ID NO: 10153 - DNA, 32 bp, Artificial Sequence
  Synthetic polynucleotide
ccgcacgtgcgctttcttttttttacgacttt

SEQ ID NO: 10154 - DNA, 32 bp, Artificial Sequence
  Synthetic polynucleotide
ccgcacgtgcgctttccgtcttaatttttttt

SEQ ID NO: 10155 - DNA, 32 bp, Artificial Sequence
  Synthetic polynucleotide
ttttttttaggagaagcacgacgacgggaatt

SEQ ID NO: 10156 - DNA, 32 bp, Artificial Sequence
  Synthetic polynucleotide
cctactctttttttttcacgacgacgggaatt

SEQ ID NO: 10157 - DNA, 32 bp, Artificial Sequence
  Synthetic polynucleotide
cctactctaggagaagttttttttcgggaatt

SEQ ID NO: 10158 - DNA, 32 bp, Artificial Sequence
  Synthetic polynucleotide
cctactctaggagaagcacgacgatttttttt

SEQ ID NO: 10159 - DNA, 32 bp, Artificial Sequence
  Synthetic polynucleotide
ttttttttgcactgccttccgcgtgggtatag

SEQ ID NO: 10160 - DNA, 32 bp, Artificial Sequence
  Synthetic polynucleotide
ggcgatacttttttttttccgcgtgggtatag

SEQ ID NO: 10161 - DNA, 32 bp, Artificial Sequence
  Synthetic polynucleotide
ggcgatacgcactgccttttttttgggtatag

SEQ ID NO: 10162 - DNA, 32 bp, Artificial Sequence
  Synthetic polynucleotide
ggcgatacgcactgccttccgcgttttttttt

SEQ ID NO: 10163 - DNA, 32 bp, Artificial Sequence
  Synthetic polynucleotide
ttttttttagtggagctgtcgtataatgggta

SEQ ID NO: 10164 - DNA, 32 bp, Artificial Sequence
  Synthetic polynucleotide
cagaaacttttttttttgtcgtataatgggta

SEQ ID NO: 10165 - DNA, 32 bp, Artificial Sequence
  Synthetic polynucleotide
cagaaactagtggagcttttttttaatgggta

SEQ ID NO: 10166 - DNA, 32 bp, Artificial Sequence
  Synthetic polynucleotide
cagaaactagtggagctgtcgtattttttttt

SEQ ID NO: 10167 - DNA, 32 bp, Artificial Sequence
  Synthetic polynucleotide
ttttttttaggtctacgtgtcaagggaagttc

SEQ ID NO: 10168 - DNA, 32 bp, Artificial Sequence
  Synthetic polynucleotide
gaggtagcttttttttgtgtcaagggaagttc

SEQ ID NO: 10169 - DNA, 32 bp, Artificial Sequence
  Synthetic polynucleotide
gaggtagcaggtctacttttttttggaagttc

SEQ ID NO: 10170 - DNA, 32 bp, Artificial Sequence
  Synthetic polynucleotide
gaggtagcaggtctacgtgtcaagtttttttt

SEQ ID NO: 10171 - DNA, 32 bp, Artificial Sequence
  Synthetic polynucleotide
ttttttttgcgtatcgtcctcggtagggtgta

SEQ ID NO: 10172 - DNA, 32 bp, Artificial Sequence
  Synthetic polynucleotide
actctcgttttttttttcctcggtagggtgta

SEQ ID NO: 10173 - DNA, 32 bp, Artificial Sequence
  Synthetic polynucleotide
actctcgtgcgtatcgttttttttagggtgta

SEQ ID NO: 10174 - DNA, 32 bp, Artificial Sequence
  Synthetic polynucleotide
actctcgtgcgtatcgtcctcggttttttttt

SEQ ID NO: 10175 - DNA, 32 bp, Artificial Sequence
  Synthetic polynucleotide
ttttttttatgccagctcatacgacaagaact

SEQ ID NO: 10176 - DNA, 32 bp, Artificial Sequence
  Synthetic polynucleotide
cgagatgttttttttttcatacgacaagaact

SEQ ID NO: 10177 - DNA, 32 bp, Artificial Sequence
  Synthetic polynucleotide
cgagatgtatgccagcttttttttcaagaact

SEQ ID NO: 10178 - DNA, 32 bp, Artificial Sequence
  Synthetic polynucleotide
cgagatgtatgccagctcatacgatttttttt

SEQ ID NO: 10179 - DNA, 32 bp, Artificial Sequence
  Synthetic polynucleotide
tttttttttctcataaaaaccgttatggtttc

SEQ ID NO: 10180 - DNA, 32 bp, Artificial Sequence
  Synthetic polynucleotide
cgtcgtctttttttttaaaccgttatggtttc

SEQ ID NO: 10181 - DNA, 32 bp, Artificial Sequence
  Synthetic polynucleotide
cgtcgtcttctcataattttttttatggtttc

SEQ ID NO: 10182 - DNA, 32 bp, Artificial Sequence
  Synthetic polynucleotide
cgtcgtcttctcataaaaaccgtttttttttt

SEQ ID NO: 10183 - DNA, 32 bp, Artificial Sequence
  Synthetic polynucleotide
ttttttttaggagatctaactaagtggggcac

SEQ ID NO: 10184 - DNA, 32 bp, Artificial Sequence
  Synthetic polynucleotide
tggatatctttttttttaactaagtggggcac

SEQ ID NO: 10185 - DNA, 32 bp, Artificial Sequence
  Synthetic polynucleotide
tggatatcaggagatctttttttttggggcac

SEQ ID NO: 10186 - DNA, 32 bp, Artificial Sequence
  Synthetic polynucleotide
tggatatcaggagatctaactaagtttttttt

SEQ ID NO: 10187 - DNA, 32 bp, Artificial Sequence
  Synthetic polynucleotide
ttttttttatgtaccgaacagtgagctattcg

SEQ ID NO: 10188 - DNA, 32 bp, Artificial Sequence
  Synthetic polynucleotide
tcaagctgttttttttaacagtgagctattcg

SEQ ID NO: 10189 - DNA, 32 bp, Artificial Sequence
  Synthetic polynucleotide
tcaagctgatgtaccgttttttttgctattcg

SEQ ID NO: 10190 - DNA, 32 bp, Artificial Sequence
  Synthetic polynucleotide
tcaagctgatgtaccgaacagtgatttttttt

SEQ ID NO: 10191 - DNA, 32 bp, Artificial Sequence
  Synthetic polynucleotide
ttttttttgtcttgcgggtacacctcacttgc

SEQ ID NO: 10192 - DNA, 32 bp, Artificial Sequence
  Synthetic polynucleotide
ccccaagtttttttttggtacacctcacttgc

SEQ ID NO: 10193 - DNA, 32 bp, Artificial Sequence
  Synthetic polynucleotide
ccccaagtgtcttgcgtttttttttcacttgc

SEQ ID NO: 10194 - DNA, 32 bp, Artificial Sequence
  Synthetic polynucleotide
ccccaagtgtcttgcgggtacacctttttttt

SEQ ID NO: 10195 - DNA, 32 bp, Artificial Sequence
  Synthetic polynucleotide
ttttttttgctacatggcagtccgatgttggg

SEQ ID NO: 10196 - DNA, 32 bp, Artificial Sequence
  Synthetic polynucleotide
tcgtacagttttttttgcagtccgatgttggg

SEQ ID NO: 10197 - DNA, 32 bp, Artificial Sequence
  Synthetic polynucleotide
tcgtacaggctacatgttttttttatgttggg

SEQ ID NO: 10198 - DNA, 32 bp, Artificial Sequence
  Synthetic polynucleotide
tcgtacaggctacatggcagtccgtttttttt

SEQ ID NO: 10199 - DNA, 32 bp, Artificial Sequence
  Synthetic polynucleotide
ttttttttggactcatcctacaatagctttat

SEQ ID NO: 10200 - DNA, 32 bp, Artificial Sequence
  Synthetic polynucleotide
tatttgacttttttttcctacaatagctttat

SEQ ID NO: 10201 - DNA, 32 bp, Artificial Sequence
  Synthetic polynucleotide
tatttgacggactcatttttttttagctttat

SEQ ID NO: 10202 - DNA, 32 bp, Artificial Sequence
  Synthetic polynucleotide
tatttgacggactcatcctacaattttttttt

SEQ ID NO: 10203 - DNA, 32 bp, Artificial Sequence
  Synthetic polynucleotide
ttttttttagcacgcatttcaacttcttgcca

SEQ ID NO: 10204 - DNA, 32 bp, Artificial Sequence
  Synthetic polynucleotide
tgtgggcttttttttttttcaacttcttgcca

SEQ ID NO: 10205 - DNA, 32 bp, Artificial Sequence
  Synthetic polynucleotide
tgtgggctagcacgcatttttttttcttgcca

SEQ ID NO: 10206 - DNA, 32 bp, Artificial Sequence
  Synthetic polynucleotide
tgtgggctagcacgcatttcaacttttttttt

SEQ ID NO: 10207 - DNA, 32 bp, Artificial Sequence
  Synthetic polynucleotide
tttttttttgtcaagtgtgcagctatccgaat

SEQ ID NO: 10208 - DNA, 32 bp, Artificial Sequence
  Synthetic polynucleotide
ctaggaccttttttttgtgcagctatccgaat

SEQ ID NO: 10209 - DNA, 32 bp, Artificial Sequence
  Synthetic polynucleotide
ctaggacctgtcaagtttttttttatccgaat

SEQ ID NO: 10210 - DNA, 32 bp, Artificial Sequence
  Synthetic polynucleotide
ctaggacctgtcaagtgtgcagcttttttttt

SEQ ID NO: 10211 - DNA, 32 bp, Artificial Sequence
  Synthetic polynucleotide
tttttttttaaccctttaagcgcgcacccgtt

SEQ ID NO: 10212 - DNA, 32 bp, Artificial Sequence
  Synthetic polynucleotide
tacgctattttttttttaagcgcgcacccgtt

SEQ ID NO: 10213 - DNA, 32 bp, Artificial Sequence
  Synthetic polynucleotide
tacgctattaacccttttttttttcacccgtt

SEQ ID NO: 10214 - DNA, 32 bp, Artificial Sequence
  Synthetic polynucleotide
tacgctattaaccctttaagcgcgtttttttt

SEQ ID NO: 10215 - DNA, 32 bp, Artificial Sequence
  Synthetic polynucleotide
ttttttttgtccggtcgtgggtaagttatgga

SEQ ID NO: 10216 - DNA, 32 bp, Artificial Sequence
  Synthetic polynucleotide
gtgggagattttttttgtgggtaagttatgga

SEQ ID NO: 10217 - DNA, 32 bp, Artificial Sequence
  Synthetic polynucleotide
gtgggagagtccggtcttttttttgttatgga

SEQ ID NO: 10218 - DNA, 32 bp, Artificial Sequence
  Synthetic polynucleotide
gtgggagagtccggtcgtgggtaatttttttt

SEQ ID NO: 10219 - DNA, 32 bp, Artificial Sequence
  Synthetic polynucleotide
ttttttttttggacgggcctggccctacttca

SEQ ID NO: 10220 - DNA, 32 bp, Artificial Sequence
  Synthetic polynucleotide
agaaccggttttttttgcctggccctacttca

SEQ ID NO: 10221 - DNA, 32 bp, Artificial Sequence
  Synthetic polynucleotide
agaaccggttggacggttttttttctacttca

SEQ ID NO: 10222 - DNA, 32 bp, Artificial Sequence
  Synthetic polynucleotide
agaaccggttggacgggcctggcctttttttt

SEQ ID NO: 10223 - DNA, 32 bp, Artificial Sequence
  Synthetic polynucleotide
ttttttttactctagccggtgagattccccag

SEQ ID NO: 10224 - DNA, 32 bp, Artificial Sequence
  Synthetic polynucleotide
ccatgaaattttttttcggtgagattccccag

SEQ ID NO: 10225 - DNA, 32 bp, Artificial Sequence
  Synthetic polynucleotide
ccatgaaaactctagcttttttttttccccag

SEQ ID NO: 10226 - DNA, 32 bp, Artificial Sequence
  Synthetic polynucleotide
ccatgaaaactctagccggtgagatttttttt

SEQ ID NO: 10227 - DNA, 32 bp, Artificial Sequence
  Synthetic polynucleotide
tttttttttcgcgtcgccacaaagggtgtcag

SEQ ID NO: 10228 - DNA, 32 bp, Artificial Sequence
  Synthetic polynucleotide
tacttgaattttttttccacaaagggtgtcag

SEQ ID NO: 10229 - DNA, 32 bp, Artificial Sequence
  Synthetic polynucleotide
tacttgaatcgcgtcgttttttttggtgtcag

SEQ ID NO: 10230 - DNA, 32 bp, Artificial Sequence
  Synthetic polynucleotide
tacttgaatcgcgtcgccacaaagtttttttt

SEQ ID NO: 10231 - DNA, 32 bp, Artificial Sequence
  Synthetic polynucleotide
tttttttttcaccgaacgtacgcatacgattt

SEQ ID NO: 10232 - DNA, 32 bp, Artificial Sequence
  Synthetic polynucleotide
gcgccagattttttttcgtacgcatacgattt

SEQ ID NO: 10233 - DNA, 32 bp, Artificial Sequence
  Synthetic polynucleotide
gcgccagatcaccgaatttttttttacgattt

SEQ ID NO: 10234 - DNA, 32 bp, Artificial Sequence
  Synthetic polynucleotide
gcgccagatcaccgaacgtacgcatttttttt

SEQ ID NO: 10235 - DNA, 32 bp, Artificial Sequence
  Synthetic polynucleotide
ttttttttgtcctcacctctccgccatattgt

SEQ ID NO: 10236 - DNA, 32 bp, Artificial Sequence
  Synthetic polynucleotide
cggggaggttttttttctctccgccatattgt

SEQ ID NO: 10237 - DNA, 32 bp, Artificial Sequence
  Synthetic polynucleotide
cggggagggtcctcacttttttttcatattgt

SEQ ID NO: 10238 - DNA, 32 bp, Artificial Sequence
  Synthetic polynucleotide
cggggagggtcctcacctctccgctttttttt

SEQ ID NO: 10239 - DNA, 32 bp, Artificial Sequence
  Synthetic polynucleotide
ttttttttttgtaatgacgactctcatctgat

SEQ ID NO: 10240 - DNA, 32 bp, Artificial Sequence
  Synthetic polynucleotide
agcaggtcttttttttacgactctcatctgat

SEQ ID NO: 10241 - DNA, 32 bp, Artificial Sequence
  Synthetic polynucleotide
agcaggtcttgtaatgttttttttcatctgat

SEQ ID NO: 10242 - DNA, 32 bp, Artificial Sequence
  Synthetic polynucleotide
agcaggtcttgtaatgacgactcttttttttt

SEQ ID NO: 10243 - DNA, 32 bp, Artificial Sequence
  Synthetic polynucleotide
ttttttttgttaatgcgtgcatctacatggtc

SEQ ID NO: 10244 - DNA, 32 bp, Artificial Sequence
  Synthetic polynucleotide
aattcatcttttttttgtgcatctacatggtc

SEQ ID NO: 10245 - DNA, 32 bp, Artificial Sequence
  Synthetic polynucleotide
aattcatcgttaatgcttttttttacatggtc

SEQ ID NO: 10246 - DNA, 32 bp, Artificial Sequence
  Synthetic polynucleotide
aattcatcgttaatgcgtgcatcttttttttt

SEQ ID NO: 10247 - DNA, 32 bp, Artificial Sequence
  Synthetic polynucleotide
ttttttttccgaacgaggaacttgatgtcatg

SEQ ID NO: 10248 - DNA, 32 bp, Artificial Sequence
  Synthetic polynucleotide
tgcttatcttttttttggaacttgatgtcatg

SEQ ID NO: 10249 - DNA, 32 bp, Artificial Sequence
  Synthetic polynucleotide
tgcttatcccgaacgattttttttatgtcatg

SEQ ID NO: 10250 - DNA, 32 bp, Artificial Sequence
  Synthetic polynucleotide
tgcttatcccgaacgaggaacttgtttttttt

SEQ ID NO: 10251 - DNA, 32 bp, Artificial Sequence
  Synthetic polynucleotide
ttttttttggtccttcaattagaagtcgaatt

SEQ ID NO: 10252 - DNA, 32 bp, Artificial Sequence
  Synthetic polynucleotide
aaagcttcttttttttaattagaagtcgaatt

SEQ ID NO: 10253 - DNA, 32 bp, Artificial Sequence
  Synthetic polynucleotide
aaagcttcggtccttcttttttttgtcgaatt

SEQ ID NO: 10254 - DNA, 32 bp, Artificial Sequence
  Synthetic polynucleotide
aaagcttcggtccttcaattagaatttttttt

SEQ ID NO: 10255 - DNA, 32 bp, Artificial Sequence
  Synthetic polynucleotide
ttttttttggctagaatgctggtgaaagatac

SEQ ID NO: 10256 - DNA, 32 bp, Artificial Sequence
  Synthetic polynucleotide
attaatactttttttttgctggtgaaagatac

SEQ ID NO: 10257 - DNA, 32 bp, Artificial Sequence
  Synthetic polynucleotide
attaatacggctagaattttttttaaagatac

SEQ ID NO: 10258 - DNA, 32 bp, Artificial Sequence
  Synthetic polynucleotide
attaatacggctagaatgctggtgtttttttt

SEQ ID NO: 10259 - DNA, 32 bp, Artificial Sequence
  Synthetic polynucleotide
ttttttttgacttgattgttttcgctaggtgg

SEQ ID NO: 10260 - DNA, 32 bp, Artificial Sequence
  Synthetic polynucleotide
cgtcactttttttttttgttttcgctaggtgg

SEQ ID NO: 10261 - DNA, 32 bp, Artificial Sequence
  Synthetic polynucleotide
cgtcacttgacttgatttttttttctaggtgg

SEQ ID NO: 10262 - DNA, 32 bp, Artificial Sequence
  Synthetic polynucleotide
cgtcacttgacttgattgttttcgtttttttt

SEQ ID NO: 10263 - DNA, 32 bp, Artificial Sequence
  Synthetic polynucleotide
ttttttttgctgaggactcgttcgggtgctac

SEQ ID NO: 10264 - DNA, 32 bp, Artificial Sequence
  Synthetic polynucleotide
gcttctcgttttttttctcgttcgggtgctac

SEQ ID NO: 10265 - DNA, 32 bp, Artificial Sequence
  Synthetic polynucleotide
gcttctcggctgaggattttttttggtgctac

SEQ ID NO: 10266 - DNA, 32 bp, Artificial Sequence
  Synthetic polynucleotide
gcttctcggctgaggactcgttcgtttttttt

SEQ ID NO: 10267 - DNA, 32 bp, Artificial Sequence
  Synthetic polynucleotide
ttttttttatctataccgggtgtccctcaagc

SEQ ID NO: 10268 - DNA, 32 bp, Artificial Sequence
  Synthetic polynucleotide
gccttgtcttttttttcgggtgtccctcaagc

SEQ ID NO: 10269 - DNA, 32 bp, Artificial Sequence
  Synthetic polynucleotide
gccttgtcatctatacttttttttcctcaagc

SEQ ID NO: 10270 - DNA, 32 bp, Artificial Sequence
  Synthetic polynucleotide
gccttgtcatctataccgggtgtctttttttt

SEQ ID NO: 10271 - DNA, 32 bp, Artificial Sequence
  Synthetic polynucleotide
ttttttttctgaagcggcgttaaactgcccag

SEQ ID NO: 10272 - DNA, 32 bp, Artificial Sequence
  Synthetic polynucleotide
gaggagcgttttttttgcgttaaactgcccag

SEQ ID NO: 10273 - DNA, 32 bp, Artificial Sequence
  Synthetic polynucleotide
gaggagcgctgaagcgttttttttctgcccag

SEQ ID NO: 10274 - DNA, 32 bp, Artificial Sequence
  Synthetic polynucleotide
gaggagcgctgaagcggcgttaaatttttttt

SEQ ID NO: 10275 - DNA, 32 bp, Artificial Sequence
  Synthetic polynucleotide
tttttttttgacatcgtctgatggatctcagc

SEQ ID NO: 10276 - DNA, 32 bp, Artificial Sequence
  Synthetic polynucleotide
acccgagatttttttttctgatggatctcagc

SEQ ID NO: 10277 - DNA, 32 bp, Artificial Sequence
  Synthetic polynucleotide
acccgagatgacatcgttttttttatctcagc

SEQ ID NO: 10278 - DNA, 32 bp, Artificial Sequence
  Synthetic polynucleotide
acccgagatgacatcgtctgatggtttttttt

SEQ ID NO: 10279 - DNA, 32 bp, Artificial Sequence
  Synthetic polynucleotide
ttttttttcccgctcgccacatgaaccgctct

SEQ ID NO: 10280 - DNA, 32 bp, Artificial Sequence
  Synthetic polynucleotide
cccatggattttttttccacatgaaccgctct

SEQ ID NO: 10281 - DNA, 32 bp, Artificial Sequence
  Synthetic polynucleotide
cccatggacccgctcgttttttttaccgctct

SEQ ID NO: 10282 - DNA, 32 bp, Artificial Sequence
  Synthetic polynucleotide
cccatggacccgctcgccacatgatttttttt

SEQ ID NO: 10283 - DNA, 32 bp, Artificial Sequence
  Synthetic polynucleotide
tttttttttggtgaatactcgctagtcaactt

SEQ ID NO: 10284 - DNA, 32 bp, Artificial Sequence
  Synthetic polynucleotide
gcctgtgattttttttactcgctagtcaactt

SEQ ID NO: 10285 - DNA, 32 bp, Artificial Sequence
  Synthetic polynucleotide
gcctgtgatggtgaatttttttttgtcaactt

SEQ ID NO: 10286 - DNA, 32 bp, Artificial Sequence
  Synthetic polynucleotide
gcctgtgatggtgaatactcgctatttttttt

SEQ ID NO: 10287 - DNA, 32 bp, Artificial Sequence
  Synthetic polynucleotide
ttttttttcgtagttcgtaaacgataggtttc

SEQ ID NO: 10288 - DNA, 32 bp, Artificial Sequence
  Synthetic polynucleotide
accagttcttttttttgtaaacgataggtttc

SEQ ID NO: 10289 - DNA, 32 bp, Artificial Sequence
  Synthetic polynucleotide
accagttccgtagttctttttttttaggtttc

SEQ ID NO: 10290 - DNA, 32 bp, Artificial Sequence
  Synthetic polynucleotide
accagttccgtagttcgtaaacgatttttttt

SEQ ID NO: 10291 - DNA, 32 bp, Artificial Sequence
  Synthetic polynucleotide
ttttttttcacaaggggattgggtatgaaaac

SEQ ID NO: 10292 - DNA, 32 bp, Artificial Sequence
  Synthetic polynucleotide
tcacagtgttttttttgattgggtatgaaaac

SEQ ID NO: 10293 - DNA, 32 bp, Artificial Sequence
  Synthetic polynucleotide
tcacagtgcacaagggttttttttatgaaaac

SEQ ID NO: 10294 - DNA, 32 bp, Artificial Sequence
  Synthetic polynucleotide
tcacagtgcacaaggggattgggttttttttt

SEQ ID NO: 10295 - DNA, 32 bp, Artificial Sequence
  Synthetic polynucleotide
ttttttttgtggaaatgccactacgatattca

SEQ ID NO: 10296 - DNA, 32 bp, Artificial Sequence
  Synthetic polynucleotide
ccccggaattttttttgccactacgatattca

SEQ ID NO: 10297 - DNA, 32 bp, Artificial Sequence
  Synthetic polynucleotide
ccccggaagtggaaatttttttttgatattca

SEQ ID NO: 10298 - DNA, 32 bp, Artificial Sequence
  Synthetic polynucleotide
ccccggaagtggaaatgccactactttttttt

SEQ ID NO: 10299 - DNA, 32 bp, Artificial Sequence
  Synthetic polynucleotide
ttttttttttgatttaccgaattatggtgtgt

SEQ ID NO: 10300 - DNA, 32 bp, Artificial Sequence
  Synthetic polynucleotide
ggagaatcttttttttccgaattatggtgtgt

SEQ ID NO: 10301 - DNA, 32 bp, Artificial Sequence
  Synthetic polynucleotide
ggagaatcttgatttatttttttttggtgtgt

SEQ ID NO: 10302 - DNA, 32 bp, Artificial Sequence
  Synthetic polynucleotide
ggagaatcttgatttaccgaattatttttttt

SEQ ID NO: 10303 - DNA, 32 bp, Artificial Sequence
  Synthetic polynucleotide
ttttttttgctgccattctggttccccactgt

SEQ ID NO: 10304 - DNA, 32 bp, Artificial Sequence
  Synthetic polynucleotide
gctctaaatttttttttctggttccccactgt

SEQ ID NO: 10305 - DNA, 32 bp, Artificial Sequence
  Synthetic polynucleotide
gctctaaagctgccatttttttttcccactgt

SEQ ID NO: 10306 - DNA, 32 bp, Artificial Sequence
  Synthetic polynucleotide
gctctaaagctgccattctggttctttttttt

SEQ ID NO: 10307 - DNA, 32 bp, Artificial Sequence
  Synthetic polynucleotide
tttttttttaaggaatcggacggaaaactaca

SEQ ID NO: 10308 - DNA, 32 bp, Artificial Sequence
  Synthetic polynucleotide
tctgatatttttttttcggacggaaaactaca

SEQ ID NO: 10309 - DNA, 32 bp, Artificial Sequence
  Synthetic polynucleotide
tctgatattaaggaatttttttttaaactaca

SEQ ID NO: 10310 - DNA, 32 bp, Artificial Sequence
  Synthetic polynucleotide
tctgatattaaggaatcggacggatttttttt

SEQ ID NO: 10311 - DNA, 32 bp, Artificial Sequence
  Synthetic polynucleotide
ttttttttctgtgctccccgagtccagcatta

SEQ ID NO: 10312 - DNA, 32 bp, Artificial Sequence
  Synthetic polynucleotide
ctggttttttttttttcccgagtccagcatta

SEQ ID NO: 10313 - DNA, 32 bp, Artificial Sequence
  Synthetic polynucleotide
ctggttttctgtgctcttttttttcagcatta

SEQ ID NO: 10314 - DNA, 32 bp, Artificial Sequence
  Synthetic polynucleotide
ctggttttctgtgctccccgagtctttttttt

SEQ ID NO: 10315 - DNA, 32 bp, Artificial Sequence
  Synthetic polynucleotide
ttttttttgattgcgcgtaatggtcgtagtgg

SEQ ID NO: 10316 - DNA, 32 bp, Artificial Sequence
  Synthetic polynucleotide
ccgtaatcttttttttgtaatggtcgtagtgg

SEQ ID NO: 10317 - DNA, 32 bp, Artificial Sequence
  Synthetic polynucleotide
ccgtaatcgattgcgcttttttttcgtagtgg

SEQ ID NO: 10318 - DNA, 32 bp, Artificial Sequence
  Synthetic polynucleotide
ccgtaatcgattgcgcgtaatggttttttttt

SEQ ID NO: 10319 - DNA, 32 bp, Artificial Sequence
  Synthetic polynucleotide
ttttttttctaagccgtataaagcgtttggaa

SEQ ID NO: 10320 - DNA, 32 bp, Artificial Sequence
  Synthetic polynucleotide
tgccatgatttttttttataaagcgtttggaa

SEQ ID NO: 10321 - DNA, 32 bp, Artificial Sequence
  Synthetic polynucleotide
tgccatgactaagccgttttttttgtttggaa

SEQ ID NO: 10322 - DNA, 32 bp, Artificial Sequence
  Synthetic polynucleotide
tgccatgactaagccgtataaagctttttttt

SEQ ID NO: 10323 - DNA, 32 bp, Artificial Sequence
  Synthetic polynucleotide
ttttttttaataacttctgtatgaatctatgt

SEQ ID NO: 10324 - DNA, 32 bp, Artificial Sequence
  Synthetic polynucleotide
accaatcattttttttctgtatgaatctatgt

SEQ ID NO: 10325 - DNA, 32 bp, Artificial Sequence
  Synthetic polynucleotide
accaatcaaataacttttttttttatctatgt

SEQ ID NO: 10326 - DNA, 32 bp, Artificial Sequence
  Synthetic polynucleotide
accaatcaaataacttctgtatgatttttttt

SEQ ID NO: 10327 - DNA, 32 bp, Artificial Sequence
  Synthetic polynucleotide
tttttttttacactaatgcggcgccctgcgaa

SEQ ID NO: 10328 - DNA, 32 bp, Artificial Sequence
  Synthetic polynucleotide
gataatactttttttttgcggcgccctgcgaa

SEQ ID NO: 10329 - DNA, 32 bp, Artificial Sequence
  Synthetic polynucleotide
gataatactacactaattttttttcctgcgaa

SEQ ID NO: 10330 - DNA, 32 bp, Artificial Sequence
  Synthetic polynucleotide
gataatactacactaatgcggcgctttttttt

SEQ ID NO: 10331 - DNA, 32 bp, Artificial Sequence
  Synthetic polynucleotide
ttttttttattgacgcccaccttattacgagt

SEQ ID NO: 10332 - DNA, 32 bp, Artificial Sequence
  Synthetic polynucleotide
ttctgctattttttttccaccttattacgagt

SEQ ID NO: 10333 - DNA, 32 bp, Artificial Sequence
  Synthetic polynucleotide
ttctgctaattgacgcttttttttttacgagt

SEQ ID NO: 10334 - DNA, 32 bp, Artificial Sequence
  Synthetic polynucleotide
ttctgctaattgacgcccaccttatttttttt

SEQ ID NO: 10335 - DNA, 32 bp, Artificial Sequence
  Synthetic polynucleotide
ttttttttgcaaattatacgagctagacctgt

SEQ ID NO: 10336 - DNA, 32 bp, Artificial Sequence
  Synthetic polynucleotide
cttcgtcatttttttttacgagctagacctgt

SEQ ID NO: 10337 - DNA, 32 bp, Artificial Sequence
  Synthetic polynucleotide
cttcgtcagcaaattattttttttagacctgt

SEQ ID NO: 10338 - DNA, 32 bp, Artificial Sequence
  Synthetic polynucleotide
cttcgtcagcaaattatacgagcttttttttt

SEQ ID NO: 10339 - DNA, 32 bp, Artificial Sequence
  Synthetic polynucleotide
tttttttttgacggagctagagctactcgccg

SEQ ID NO: 10340 - DNA, 32 bp, Artificial Sequence
  Synthetic polynucleotide
aggaggtgttttttttctagagctactcgccg

SEQ ID NO: 10341 - DNA, 32 bp, Artificial Sequence
  Synthetic polynucleotide
aggaggtgtgacggagttttttttactcgccg

SEQ ID NO: 10342 - DNA, 32 bp, Artificial Sequence
  Synthetic polynucleotide
aggaggtgtgacggagctagagcttttttttt

SEQ ID NO: 10343 - DNA, 32 bp, Artificial Sequence
  Synthetic polynucleotide
ttttttttaccctaacatagaatataggtcac

SEQ ID NO: 10344 - DNA, 32 bp, Artificial Sequence
  Synthetic polynucleotide
ctcccacattttttttatagaatataggtcac

SEQ ID NO: 10345 - DNA, 32 bp, Artificial Sequence
  Synthetic polynucleotide
ctcccacaaccctaactttttttttaggtcac

SEQ ID NO: 10346 - DNA, 32 bp, Artificial Sequence
  Synthetic polynucleotide
ctcccacaaccctaacatagaatatttttttt

SEQ ID NO: 10347 - DNA, 32 bp, Artificial Sequence
  Synthetic polynucleotide
tttttttttaatgatctgtaccattatcaaag

SEQ ID NO: 10348 - DNA, 32 bp, Artificial Sequence
  Synthetic polynucleotide
ggactatttttttttttgtaccattatcaaag

SEQ ID NO: 10349 - DNA, 32 bp, Artificial Sequence
  Synthetic polynucleotide
ggactatttaatgatctttttttttatcaaag

SEQ ID NO: 10350 - DNA, 32 bp, Artificial Sequence
  Synthetic polynucleotide
ggactatttaatgatctgtaccattttttttt

SEQ ID NO: 10351 - DNA, 32 bp, Artificial Sequence
  Synthetic polynucleotide
ttttttttcatttcttcgcggaactttaaacc

SEQ ID NO: 10352 - DNA, 32 bp, Artificial Sequence
  Synthetic polynucleotide
agtaattgttttttttcgcggaactttaaacc

SEQ ID NO: 10353 - DNA, 32 bp, Artificial Sequence
  Synthetic polynucleotide
agtaattgcatttctttttttttttttaaacc

SEQ ID NO: 10354 - DNA, 32 bp, Artificial Sequence
  Synthetic polynucleotide
agtaattgcatttcttcgcggaactttttttt

SEQ ID NO: 10355 - DNA, 32 bp, Artificial Sequence
  Synthetic polynucleotide
tttttttttcgctttttaacacttggtctcga

SEQ ID NO: 10356 - DNA, 32 bp, Artificial Sequence
  Synthetic polynucleotide
tactggagtttttttttaacacttggtctcga

SEQ ID NO: 10357 - DNA, 32 bp, Artificial Sequence
  Synthetic polynucleotide
tactggagtcgcttttttttttttggtctcga

SEQ ID NO: 10358 - DNA, 32 bp, Artificial Sequence
  Synthetic polynucleotide
tactggagtcgctttttaacactttttttttt

SEQ ID NO: 10359 - DNA, 32 bp, Artificial Sequence
  Synthetic polynucleotide
ttttttttaatggcaaagcacgtagagataat

SEQ ID NO: 10360 - DNA, 32 bp, Artificial Sequence
  Synthetic polynucleotide
gatgaacattttttttagcacgtagagataat

SEQ ID NO: 10361 - DNA, 32 bp, Artificial Sequence
  Synthetic polynucleotide
gatgaacaaatggcaattttttttgagataat

SEQ ID NO: 10362 - DNA, 32 bp, Artificial Sequence
  Synthetic polynucleotide
gatgaacaaatggcaaagcacgtatttttttt

SEQ ID NO: 10363 - DNA, 32 bp, Artificial Sequence
  Synthetic polynucleotide
ttttttttgggtgaccatagaatgctattgag

SEQ ID NO: 10364 - DNA, 32 bp, Artificial Sequence
  Synthetic polynucleotide
accattgtttttttttatagaatgctattgag

SEQ ID NO: 10365 - DNA, 32 bp, Artificial Sequence
  Synthetic polynucleotide
accattgtgggtgaccttttttttctattgag

SEQ ID NO: 10366 - DNA, 32 bp, Artificial Sequence
  Synthetic polynucleotide
accattgtgggtgaccatagaatgtttttttt

SEQ ID NO: 10367 - DNA, 32 bp, Artificial Sequence
  Synthetic polynucleotide
ttttttttcaaaagatgttatacaggtccggc

SEQ ID NO: 10368 - DNA, 32 bp, Artificial Sequence
  Synthetic polynucleotide
cagtgcggttttttttgttatacaggtccggc

SEQ ID NO: 10369 - DNA, 32 bp, Artificial Sequence
  Synthetic polynucleotide
cagtgcggcaaaagatttttttttggtccggc

SEQ ID NO: 10370 - DNA, 32 bp, Artificial Sequence
  Synthetic polynucleotide
cagtgcggcaaaagatgttatacatttttttt

SEQ ID NO: 10371 - DNA, 32 bp, Artificial Sequence
  Synthetic polynucleotide
ttttttttagtaaatgggtagaaggaactctg

SEQ ID NO: 10372 - DNA, 32 bp, Artificial Sequence
  Synthetic polynucleotide
gggagctgttttttttggtagaaggaactctg

SEQ ID NO: 10373 - DNA, 32 bp, Artificial Sequence
  Synthetic polynucleotide
gggagctgagtaaatgttttttttgaactctg

SEQ ID NO: 10374 - DNA, 32 bp, Artificial Sequence
  Synthetic polynucleotide
gggagctgagtaaatgggtagaagtttttttt

SEQ ID NO: 10375 - DNA, 32 bp, Artificial Sequence
  Synthetic polynucleotide
ttttttttacttacctcactcgcacttagatc

SEQ ID NO: 10376 - DNA, 32 bp, Artificial Sequence
  Synthetic polynucleotide
ttatattattttttttcactcgcacttagatc

SEQ ID NO: 10377 - DNA, 32 bp, Artificial Sequence
  Synthetic polynucleotide
ttatattaacttacctttttttttcttagatc

SEQ ID NO: 10378 - DNA, 32 bp, Artificial Sequence
  Synthetic polynucleotide
ttatattaacttacctcactcgcatttttttt

SEQ ID NO: 10379 - DNA, 32 bp, Artificial Sequence
  Synthetic polynucleotide
ttttttttcgcggacagcggtaacatcacata

SEQ ID NO: 10380 - DNA, 32 bp, Artificial Sequence
  Synthetic polynucleotide
acttaatattttttttgcggtaacatcacata

SEQ ID NO: 10381 - DNA, 32 bp, Artificial Sequence
  Synthetic polynucleotide
acttaatacgcggacattttttttatcacata

SEQ ID NO: 10382 - DNA, 32 bp, Artificial Sequence
  Synthetic polynucleotide
acttaatacgcggacagcggtaactttttttt

SEQ ID NO: 10383 - DNA, 32 bp, Artificial Sequence
  Synthetic polynucleotide
ttttttttcggcgaaaacttacgtgtagtgtc

SEQ ID NO: 10384 - DNA, 32 bp, Artificial Sequence
  Synthetic polynucleotide
caggcaagttttttttacttacgtgtagtgtc

SEQ ID NO: 10385 - DNA, 32 bp, Artificial Sequence
  Synthetic polynucleotide
caggcaagcggcgaaattttttttgtagtgtc

SEQ ID NO: 10386 - DNA, 32 bp, Artificial Sequence
  Synthetic polynucleotide
caggcaagcggcgaaaacttacgttttttttt

SEQ ID NO: 10387 - DNA, 32 bp, Artificial Sequence
  Synthetic polynucleotide
ttttttttcacaggatctggtctcaaacgtcc

SEQ ID NO: 10388 - DNA, 32 bp, Artificial Sequence
  Synthetic polynucleotide
attactggttttttttctggtctcaaacgtcc

SEQ ID NO: 10389 - DNA, 32 bp, Artificial Sequence
  Synthetic polynucleotide
attactggcacaggatttttttttaaacgtcc

SEQ ID NO: 10390 - DNA, 32 bp, Artificial Sequence
  Synthetic polynucleotide
attactggcacaggatctggtctctttttttt

SEQ ID NO: 10391 - DNA, 32 bp, Artificial Sequence
  Synthetic polynucleotide
ttttttttttcaggctacctatatagccattt

SEQ ID NO: 10392 - DNA, 32 bp, Artificial Sequence
  Synthetic polynucleotide
aatgttctttttttttacctatatagccattt

SEQ ID NO: 10393 - DNA, 32 bp, Artificial Sequence
  Synthetic polynucleotide
aatgttctttcaggctttttttttagccattt

SEQ ID NO: 10394 - DNA, 32 bp, Artificial Sequence
  Synthetic polynucleotide
aatgttctttcaggctacctatattttttttt

SEQ ID NO: 10395 - DNA, 32 bp, Artificial Sequence
  Synthetic polynucleotide
ttttttttcgaacccgaactcatatacgtctt

SEQ ID NO: 10396 - DNA, 32 bp, Artificial Sequence
  Synthetic polynucleotide
gcagggtgttttttttaactcatatacgtctt

SEQ ID NO: 10397 - DNA, 32 bp, Artificial Sequence
  Synthetic polynucleotide
gcagggtgcgaacccgtttttttttacgtctt

SEQ ID NO: 10398 - DNA, 32 bp, Artificial Sequence
  Synthetic polynucleotide
gcagggtgcgaacccgaactcatatttttttt

SEQ ID NO: 10399 - DNA, 32 bp, Artificial Sequence
  Synthetic polynucleotide
ttttttttccgtcgatcgaccattggtcattg

SEQ ID NO: 10400 - DNA, 32 bp, Artificial Sequence
  Synthetic polynucleotide
gagctcacttttttttcgaccattggtcattg

SEQ ID NO: 10401 - DNA, 32 bp, Artificial Sequence
  Synthetic polynucleotide
gagctcacccgtcgatttttttttggtcattg

SEQ ID NO: 10402 - DNA, 32 bp, Artificial Sequence
  Synthetic polynucleotide
gagctcacccgtcgatcgaccatttttttttt

SEQ ID NO: 10403 - DNA, 32 bp, Artificial Sequence
  Synthetic polynucleotide
ttttttttaaaaatcactgctcctttagggtc

SEQ ID NO: 10404 - DNA, 32 bp, Artificial Sequence
  Synthetic polynucleotide
gccgatggttttttttctgctcctttagggtc

SEQ ID NO: 10405 - DNA, 32 bp, Artificial Sequence
  Synthetic polynucleotide
gccgatggaaaaatcattttttttttagggtc

SEQ ID NO: 10406 - DNA, 32 bp, Artificial Sequence
  Synthetic polynucleotide
gccgatggaaaaatcactgctccttttttttt

SEQ ID NO: 10407 - DNA, 32 bp, Artificial Sequence
  Synthetic polynucleotide
tttttttttcaatttttaccgagcaaagtatt

SEQ ID NO: 10408 - DNA, 32 bp, Artificial Sequence
  Synthetic polynucleotide
ctagtaactttttttttaccgagcaaagtatt

SEQ ID NO: 10409 - DNA, 32 bp, Artificial Sequence
  Synthetic polynucleotide
ctagtaactcaattttttttttttaaagtatt

SEQ ID NO: 10410 - DNA, 32 bp, Artificial Sequence
  Synthetic polynucleotide
ctagtaactcaatttttaccgagctttttttt

SEQ ID NO: 10411 - DNA, 32 bp, Artificial Sequence
  Synthetic polynucleotide
ttttttttcaaggcgcgaatatccccggttga

SEQ ID NO: 10412 - DNA, 32 bp, Artificial Sequence
  Synthetic polynucleotide
cctaggcgttttttttgaatatccccggttga

SEQ ID NO: 10413 - DNA, 32 bp, Artificial Sequence
  Synthetic polynucleotide
cctaggcgcaaggcgcttttttttccggttga

SEQ ID NO: 10414 - DNA, 32 bp, Artificial Sequence
  Synthetic polynucleotide
cctaggcgcaaggcgcgaatatcctttttttt

SEQ ID NO: 10415 - DNA, 32 bp, Artificial Sequence
  Synthetic polynucleotide
ttttttttgaggttagcgctgatccggtttac

SEQ ID NO: 10416 - DNA, 32 bp, Artificial Sequence
  Synthetic polynucleotide
cgtttattttttttttcgctgatccggtttac

SEQ ID NO: 10417 - DNA, 32 bp, Artificial Sequence
  Synthetic polynucleotide
cgtttattgaggttagttttttttcggtttac

SEQ ID NO: 10418 - DNA, 32 bp, Artificial Sequence
  Synthetic polynucleotide
cgtttattgaggttagcgctgatctttttttt

SEQ ID NO: 10419 - DNA, 32 bp, Artificial Sequence
  Synthetic polynucleotide
ttttttttttatgtgaccccttcgtttaaaga

SEQ ID NO: 10420 - DNA, 32 bp, Artificial Sequence
  Synthetic polynucleotide
aagagcaattttttttccccttcgtttaaaga

SEQ ID NO: 10421 - DNA, 32 bp, Artificial Sequence
  Synthetic polynucleotide
aagagcaattatgtgatttttttttttaaaga

SEQ ID NO: 10422 - DNA, 32 bp, Artificial Sequence
  Synthetic polynucleotide
aagagcaattatgtgaccccttcgtttttttt

SEQ ID NO: 10423 - DNA, 32 bp, Artificial Sequence
  Synthetic polynucleotide
ttttttttagacgtcctggctcgtacccatcc

SEQ ID NO: 10424 - DNA, 32 bp, Artificial Sequence
  Synthetic polynucleotide
ctgaaggatttttttttggctcgtacccatcc

SEQ ID NO: 10425 - DNA, 32 bp, Artificial Sequence
  Synthetic polynucleotide
ctgaaggaagacgtccttttttttacccatcc

SEQ ID NO: 10426 - DNA, 32 bp, Artificial Sequence
  Synthetic polynucleotide
ctgaaggaagacgtcctggctcgttttttttt

SEQ ID NO: 10427 - DNA, 32 bp, Artificial Sequence
  Synthetic polynucleotide
tttttttttaggcggaagatgcgatttgtacg

SEQ ID NO: 10428 - DNA, 32 bp, Artificial Sequence
  Synthetic polynucleotide
agggttcattttttttagatgcgatttgtacg

SEQ ID NO: 10429 - DNA, 32 bp, Artificial Sequence
  Synthetic polynucleotide
agggttcataggcggatttttttttttgtacg

SEQ ID NO: 10430 - DNA, 32 bp, Artificial Sequence
  Synthetic polynucleotide
agggttcataggcggaagatgcgatttttttt

SEQ ID NO: 10431 - DNA, 32 bp, Artificial Sequence
  Synthetic polynucleotide
ttttttttcgatagtagaaaactgcacaactt

SEQ ID NO: 10432 - DNA, 32 bp, Artificial Sequence
  Synthetic polynucleotide
taggcaagttttttttgaaaactgcacaactt

SEQ ID NO: 10433 - DNA, 32 bp, Artificial Sequence
  Synthetic polynucleotide
taggcaagcgatagtattttttttcacaactt

SEQ ID NO: 10434 - DNA, 32 bp, Artificial Sequence
  Synthetic polynucleotide
taggcaagcgatagtagaaaactgtttttttt

SEQ ID NO: 10435 - DNA, 32 bp, Artificial Sequence
  Synthetic polynucleotide
tttttttttaagaacacccgacaaggcagcag

SEQ ID NO: 10436 - DNA, 32 bp, Artificial Sequence
  Synthetic polynucleotide
cctagaacttttttttcccgacaaggcagcag

SEQ ID NO: 10437 - DNA, 32 bp, Artificial Sequence
  Synthetic polynucleotide
cctagaactaagaacattttttttggcagcag

SEQ ID NO: 10438 - DNA, 32 bp, Artificial Sequence
  Synthetic polynucleotide
cctagaactaagaacacccgacaatttttttt

SEQ ID NO: 10439 - DNA, 32 bp, Artificial Sequence
  Synthetic polynucleotide
ttttttttccccgctccaacattttatctctt

SEQ ID NO: 10440 - DNA, 32 bp, Artificial Sequence
  Synthetic polynucleotide
tggtcggtttttttttcaacattttatctctt

SEQ ID NO: 10441 - DNA, 32 bp, Artificial Sequence
  Synthetic polynucleotide
tggtcggtccccgctctttttttttatctctt

SEQ ID NO: 10442 - DNA, 32 bp, Artificial Sequence
  Synthetic polynucleotide
tggtcggtccccgctccaacattttttttttt

SEQ ID NO: 10443 - DNA, 32 bp, Artificial Sequence
  Synthetic polynucleotide
tttttttttagcgcctgcgcgggctgactctt

SEQ ID NO: 10444 - DNA, 32 bp, Artificial Sequence
  Synthetic polynucleotide
tgggagaattttttttgcgcgggctgactctt

SEQ ID NO: 10445 - DNA, 32 bp, Artificial Sequence
  Synthetic polynucleotide
tgggagaatagcgccttttttttttgactctt

SEQ ID NO: 10446 - DNA, 32 bp, Artificial Sequence
  Synthetic polynucleotide
tgggagaatagcgcctgcgcgggctttttttt

SEQ ID NO: 10447 - DNA, 32 bp, Artificial Sequence
  Synthetic polynucleotide
tttttttttatccatttgatcctgcgtacctt

SEQ ID NO: 10448 - DNA, 32 bp, Artificial Sequence
  Synthetic polynucleotide
ggtatttttttttttttgatcctgcgtacctt

SEQ ID NO: 10449 - DNA, 32 bp, Artificial Sequence
  Synthetic polynucleotide
ggtatttttatccattttttttttcgtacctt

SEQ ID NO: 10450 - DNA, 32 bp, Artificial Sequence
  Synthetic polynucleotide
ggtatttttatccatttgatcctgtttttttt

SEQ ID NO: 10451 - DNA, 32 bp, Artificial Sequence
  Synthetic polynucleotide
ttttttttgatgcgttgatgatatggtaatcc

SEQ ID NO: 10452 - DNA, 32 bp, Artificial Sequence
  Synthetic polynucleotide
gcccgacgttttttttgatgatatggtaatcc

SEQ ID NO: 10453 - DNA, 32 bp, Artificial Sequence
  Synthetic polynucleotide
gcccgacggatgcgttttttttttggtaatcc

SEQ ID NO: 10454 - DNA, 32 bp, Artificial Sequence
  Synthetic polynucleotide
gcccgacggatgcgttgatgatattttttttt

SEQ ID NO: 10455 - DNA, 32 bp, Artificial Sequence
  Synthetic polynucleotide
ttttttttcgaaggtcgccagtaggccgggct

SEQ ID NO: 10456 - DNA, 32 bp, Artificial Sequence
  Synthetic polynucleotide
acctaatgttttttttgccagtaggccgggct

SEQ ID NO: 10457 - DNA, 32 bp, Artificial Sequence
  Synthetic polynucleotide
acctaatgcgaaggtcttttttttgccgggct

SEQ ID NO: 10458 - DNA, 32 bp, Artificial Sequence
  Synthetic polynucleotide
acctaatgcgaaggtcgccagtagtttttttt

SEQ ID NO: 10459 - DNA, 32 bp, Artificial Sequence
  Synthetic polynucleotide
tttttttttataataggctgatgccctgcttc

SEQ ID NO: 10460 - DNA, 32 bp, Artificial Sequence
  Synthetic polynucleotide
gatatcgcttttttttgctgatgccctgcttc

SEQ ID NO: 10461 - DNA, 32 bp, Artificial Sequence
  Synthetic polynucleotide
gatatcgctataatagttttttttcctgcttc

SEQ ID NO: 10462 - DNA, 32 bp, Artificial Sequence
  Synthetic polynucleotide
gatatcgctataataggctgatgctttttttt

SEQ ID NO: 10463 - DNA, 32 bp, Artificial Sequence
  Synthetic polynucleotide
ttttttttcgcattcaccatatgacttgtact

SEQ ID NO: 10464 - DNA, 32 bp, Artificial Sequence
  Synthetic polynucleotide
acagtgccttttttttccatatgacttgtact

SEQ ID NO: 10465 - DNA, 32 bp, Artificial Sequence
  Synthetic polynucleotide
acagtgcccgcattcattttttttcttgtact

SEQ ID NO: 10466 - DNA, 32 bp, Artificial Sequence
  Synthetic polynucleotide
acagtgcccgcattcaccatatgatttttttt

SEQ ID NO: 10467 - DNA, 32 bp, Artificial Sequence
  Synthetic polynucleotide
ttttttttacactcaccccgcgtatcgggaca

SEQ ID NO: 10468 - DNA, 32 bp, Artificial Sequence
  Synthetic polynucleotide
tattgaagttttttttcccgcgtatcgggaca

SEQ ID NO: 10469 - DNA, 32 bp, Artificial Sequence
  Synthetic polynucleotide
tattgaagacactcactttttttttcgggaca

SEQ ID NO: 10470 - DNA, 32 bp, Artificial Sequence
  Synthetic polynucleotide
tattgaagacactcaccccgcgtatttttttt

SEQ ID NO: 10471 - DNA, 32 bp, Artificial Sequence
  Synthetic polynucleotide
ttttttttctacaactgcactaagcgcctccg

SEQ ID NO: 10472 - DNA, 32 bp, Artificial Sequence
  Synthetic polynucleotide
aggtcatcttttttttgcactaagcgcctccg

SEQ ID NO: 10473 - DNA, 32 bp, Artificial Sequence
  Synthetic polynucleotide
aggtcatcctacaactttttttttcgcctccg

SEQ ID NO: 10474 - DNA, 32 bp, Artificial Sequence
  Synthetic polynucleotide
aggtcatcctacaactgcactaagtttttttt

SEQ ID NO: 10475 - DNA, 32 bp, Artificial Sequence
  Synthetic polynucleotide
ttttttttaggctgcgaagttgaatcgtctac

SEQ ID NO: 10476 - DNA, 32 bp, Artificial Sequence
  Synthetic polynucleotide
ttacacatttttttttaagttgaatcgtctac

SEQ ID NO: 10477 - DNA, 32 bp, Artificial Sequence
  Synthetic polynucleotide
ttacacataggctgcgtttttttttcgtctac

SEQ ID NO: 10478 - DNA, 32 bp, Artificial Sequence
  Synthetic polynucleotide
ttacacataggctgcgaagttgaatttttttt

SEQ ID NO: 10479 - DNA, 32 bp, Artificial Sequence
  Synthetic polynucleotide
ttttttttgcccaccacgtcccatattttata

SEQ ID NO: 10480 - DNA, 32 bp, Artificial Sequence
  Synthetic polynucleotide
gctgtgccttttttttcgtcccatattttata

SEQ ID NO: 10481 - DNA, 32 bp, Artificial Sequence
  Synthetic polynucleotide
gctgtgccgcccaccattttttttattttata

SEQ ID NO: 10482 - DNA, 32 bp, Artificial Sequence
  Synthetic polynucleotide
gctgtgccgcccaccacgtcccattttttttt

SEQ ID NO: 10483 - DNA, 32 bp, Artificial Sequence
  Synthetic polynucleotide
ttttttttatgtgaagcgatgcttttgccaca

SEQ ID NO: 10484 - DNA, 32 bp, Artificial Sequence
  Synthetic polynucleotide
caaagggcttttttttcgatgcttttgccaca

SEQ ID NO: 10485 - DNA, 32 bp, Artificial Sequence
  Synthetic polynucleotide
caaagggcatgtgaagttttttttttgccaca

SEQ ID NO: 10486 - DNA, 32 bp, Artificial Sequence
  Synthetic polynucleotide
caaagggcatgtgaagcgatgctttttttttt

SEQ ID NO: 10487 - DNA, 32 bp, Artificial Sequence
  Synthetic polynucleotide
ttttttttgtgaaccctaacagcaggtcggcc

SEQ ID NO: 10488 - DNA, 32 bp, Artificial Sequence
  Synthetic polynucleotide
aggatggctttttttttaacagcaggtcggcc

SEQ ID NO: 10489 - DNA, 32 bp, Artificial Sequence
  Synthetic polynucleotide
aggatggcgtgaacccttttttttggtcggcc

SEQ ID NO: 10490 - DNA, 32 bp, Artificial Sequence
  Synthetic polynucleotide
aggatggcgtgaaccctaacagcatttttttt

SEQ ID NO: 10491 - DNA, 32 bp, Artificial Sequence
  Synthetic polynucleotide
ttttttttaagcgggtacatgaggtggctggt

SEQ ID NO: 10492 - DNA, 32 bp, Artificial Sequence
  Synthetic polynucleotide
tttacgctttttttttacatgaggtggctggt

SEQ ID NO: 10493 - DNA, 32 bp, Artificial Sequence
  Synthetic polynucleotide
tttacgctaagcgggttttttttttggctggt

SEQ ID NO: 10494 - DNA, 32 bp, Artificial Sequence
  Synthetic polynucleotide
tttacgctaagcgggtacatgaggtttttttt

SEQ ID NO: 10495 - DNA, 32 bp, Artificial Sequence
  Synthetic polynucleotide
ttttttttgtcaagacataccctattgtcgtt

SEQ ID NO: 10496 - DNA, 32 bp, Artificial Sequence
  Synthetic polynucleotide
gtggcgctttttttttataccctattgtcgtt

SEQ ID NO: 10497 - DNA, 32 bp, Artificial Sequence
  Synthetic polynucleotide
gtggcgctgtcaagacttttttttttgtcgtt

SEQ ID NO: 10498 - DNA, 32 bp, Artificial Sequence
  Synthetic polynucleotide
gtggcgctgtcaagacataccctatttttttt

SEQ ID NO: 10499 - DNA, 32 bp, Artificial Sequence
  Synthetic polynucleotide
ttttttttttgttcatacttggacaaagtgag

SEQ ID NO: 10500 - DNA, 32 bp, Artificial Sequence
  Synthetic polynucleotide
acgggacattttttttacttggacaaagtgag

SEQ ID NO: 10501 - DNA, 32 bp, Artificial Sequence
  Synthetic polynucleotide
acgggacattgttcatttttttttaaagtgag

SEQ ID NO: 10502 - DNA, 32 bp, Artificial Sequence
  Synthetic polynucleotide
acgggacattgttcatacttggactttttttt

SEQ ID NO: 10503 - DNA, 32 bp, Artificial Sequence
  Synthetic polynucleotide
ttttttttgccctaacagtgttttatgctggg

SEQ ID NO: 10504 - DNA, 32 bp, Artificial Sequence
  Synthetic polynucleotide
acattactttttttttagtgttttatgctggg

SEQ ID NO: 10505 - DNA, 32 bp, Artificial Sequence
  Synthetic polynucleotide
acattactgccctaacttttttttatgctggg

SEQ ID NO: 10506 - DNA, 32 bp, Artificial Sequence
  Synthetic polynucleotide
acattactgccctaacagtgtttttttttttt

SEQ ID NO: 10507 - DNA, 32 bp, Artificial Sequence
  Synthetic polynucleotide
ttttttttggcactagcgtgacggtgaatctt

SEQ ID NO: 10508 - DNA, 32 bp, Artificial Sequence
  Synthetic polynucleotide
agtaacgcttttttttcgtgacggtgaatctt

SEQ ID NO: 10509 - DNA, 32 bp, Artificial Sequence
  Synthetic polynucleotide
agtaacgcggcactagtttttttttgaatctt

SEQ ID NO: 10510 - DNA, 32 bp, Artificial Sequence
  Synthetic polynucleotide
agtaacgcggcactagcgtgacggtttttttt

SEQ ID NO: 10511 - DNA, 32 bp, Artificial Sequence
  Synthetic polynucleotide
ttttttttagcgggtcatcatgagttttttgt

SEQ ID NO: 10512 - DNA, 32 bp, Artificial Sequence
  Synthetic polynucleotide
cataccgtttttttttatcatgagttttttgt

SEQ ID NO: 10513 - DNA, 32 bp, Artificial Sequence
  Synthetic polynucleotide
cataccgtagcgggtcttttttttttttttgt

SEQ ID NO: 10514 - DNA, 32 bp, Artificial Sequence
  Synthetic polynucleotide
cataccgtagcgggtcatcatgagtttttttt

SEQ ID NO: 10515 - DNA, 32 bp, Artificial Sequence
  Synthetic polynucleotide
ttttttttgcgtagctgatagagaactgtccc

SEQ ID NO: 10516 - DNA, 32 bp, Artificial Sequence
  Synthetic polynucleotide
ggggactcttttttttgatagagaactgtccc

SEQ ID NO: 10517 - DNA, 32 bp, Artificial Sequence
  Synthetic polynucleotide
ggggactcgcgtagctttttttttactgtccc

SEQ ID NO: 10518 - DNA, 32 bp, Artificial Sequence
  Synthetic polynucleotide
ggggactcgcgtagctgatagagatttttttt

SEQ ID NO: 10519 - DNA, 32 bp, Artificial Sequence
  Synthetic polynucleotide
tttttttttattcttcttctgaatcgcgggct

SEQ ID NO: 10520 - DNA, 32 bp, Artificial Sequence
  Synthetic polynucleotide
ctgaatggttttttttttctgaatcgcgggct

SEQ ID NO: 10521 - DNA, 32 bp, Artificial Sequence
  Synthetic polynucleotide
ctgaatggtattcttcttttttttcgcgggct

SEQ ID NO: 10522 - DNA, 32 bp, Artificial Sequence
  Synthetic polynucleotide
ctgaatggtattcttcttctgaattttttttt

SEQ ID NO: 10523 - DNA, 32 bp, Artificial Sequence
  Synthetic polynucleotide
ttttttttcctgtgaaatcccggatcttgtat

SEQ ID NO: 10524 - DNA, 32 bp, Artificial Sequence
  Synthetic polynucleotide
actcgtcgttttttttatcccggatcttgtat

SEQ ID NO: 10525 - DNA, 32 bp, Artificial Sequence
  Synthetic polynucleotide
actcgtcgcctgtgaatttttttttcttgtat

SEQ ID NO: 10526 - DNA, 32 bp, Artificial Sequence
  Synthetic polynucleotide
actcgtcgcctgtgaaatcccggatttttttt

SEQ ID NO: 10527 - DNA, 32 bp, Artificial Sequence
  Synthetic polynucleotide
ttttttttatgccgttcgtaggagttgaccta

SEQ ID NO: 10528 - DNA, 32 bp, Artificial Sequence
  Synthetic polynucleotide
agacatagttttttttcgtaggagttgaccta

SEQ ID NO: 10529 - DNA, 32 bp, Artificial Sequence
  Synthetic polynucleotide
agacatagatgccgttttttttttttgaccta

SEQ ID NO: 10530 - DNA, 32 bp, Artificial Sequence
  Synthetic polynucleotide
agacatagatgccgttcgtaggagtttttttt

SEQ ID NO: 10531 - DNA, 32 bp, Artificial Sequence
  Synthetic polynucleotide
ttttttttaggcctcgcttggacattgcgctt

SEQ ID NO: 10532 - DNA, 32 bp, Artificial Sequence
  Synthetic polynucleotide
tattgctcttttttttcttggacattgcgctt

SEQ ID NO: 10533 - DNA, 32 bp, Artificial Sequence
  Synthetic polynucleotide
tattgctcaggcctcgttttttttttgcgctt

SEQ ID NO: 10534 - DNA, 32 bp, Artificial Sequence
  Synthetic polynucleotide
tattgctcaggcctcgcttggacatttttttt

SEQ ID NO: 10535 - DNA, 32 bp, Artificial Sequence
  Synthetic polynucleotide
tttttttttcaatttccttccatgtaattata

SEQ ID NO: 10536 - DNA, 32 bp, Artificial Sequence
  Synthetic polynucleotide
cttacttgttttttttcttccatgtaattata

SEQ ID NO: 10537 - DNA, 32 bp, Artificial Sequence
  Synthetic polynucleotide
cttacttgtcaatttctttttttttaattata

SEQ ID NO: 10538 - DNA, 32 bp, Artificial Sequence
  Synthetic polynucleotide
cttacttgtcaatttccttccatgtttttttt

SEQ ID NO: 10539 - DNA, 32 bp, Artificial Sequence
  Synthetic polynucleotide
ttttttttacgccctgttaaccataaggtccg

SEQ ID NO: 10540 - DNA, 32 bp, Artificial Sequence
  Synthetic polynucleotide
gctcattcttttttttttaaccataaggtccg

SEQ ID NO: 10541 - DNA, 32 bp, Artificial Sequence
  Synthetic polynucleotide
gctcattcacgccctgttttttttaaggtccg

SEQ ID NO: 10542 - DNA, 32 bp, Artificial Sequence
  Synthetic polynucleotide
gctcattcacgccctgttaaccattttttttt

SEQ ID NO: 10543 - DNA, 32 bp, Artificial Sequence
  Synthetic polynucleotide
ttttttttggtgcgtcgaccacgtcctctcct

SEQ ID NO: 10544 - DNA, 32 bp, Artificial Sequence
  Synthetic polynucleotide
ccagcagtttttttttgaccacgtcctctcct

SEQ ID NO: 10545 - DNA, 32 bp, Artificial Sequence
  Synthetic polynucleotide
ccagcagtggtgcgtcttttttttcctctcct

SEQ ID NO: 10546 - DNA, 32 bp, Artificial Sequence
  Synthetic polynucleotide
ccagcagtggtgcgtcgaccacgttttttttt

SEQ ID NO: 10547 - DNA, 32 bp, Artificial Sequence
  Synthetic polynucleotide
ttttttttcccggtcacgcgagaccctcacgc

SEQ ID NO: 10548 - DNA, 32 bp, Artificial Sequence
  Synthetic polynucleotide
ctccgcatttttttttcgcgagaccctcacgc

SEQ ID NO: 10549 - DNA, 32 bp, Artificial Sequence
  Synthetic polynucleotide
ctccgcatcccggtcattttttttcctcacgc

SEQ ID NO: 10550 - DNA, 32 bp, Artificial Sequence
  Synthetic polynucleotide
ctccgcatcccggtcacgcgagactttttttt

SEQ ID NO: 10551 - DNA, 32 bp, Artificial Sequence
  Synthetic polynucleotide
ttttttttgcctacctacacagtgtgcagggt

SEQ ID NO: 10552 - DNA, 32 bp, Artificial Sequence
  Synthetic polynucleotide
taacaaggttttttttacacagtgtgcagggt

SEQ ID NO: 10553 - DNA, 32 bp, Artificial Sequence
  Synthetic polynucleotide
taacaagggcctaccttttttttttgcagggt

SEQ ID NO: 10554 - DNA, 32 bp, Artificial Sequence
  Synthetic polynucleotide
taacaagggcctacctacacagtgtttttttt

SEQ ID NO: 10555 - DNA, 32 bp, Artificial Sequence
  Synthetic polynucleotide
tttttttttgccatcgttttaacacatacatg

SEQ ID NO: 10556 - DNA, 32 bp, Artificial Sequence
  Synthetic polynucleotide
gcgacgctttttttttttttaacacatacatg

SEQ ID NO: 10557 - DNA, 32 bp, Artificial Sequence
  Synthetic polynucleotide
gcgacgcttgccatcgttttttttcatacatg

SEQ ID NO: 10558 - DNA, 32 bp, Artificial Sequence
  Synthetic polynucleotide
gcgacgcttgccatcgttttaacatttttttt

SEQ ID NO: 10559 - DNA, 32 bp, Artificial Sequence
  Synthetic polynucleotide
ttttttttcactttaagagccgatggagtgtt

SEQ ID NO: 10560 - DNA, 32 bp, Artificial Sequence
  Synthetic polynucleotide
gaaggctgttttttttgagccgatggagtgtt

SEQ ID NO: 10561 - DNA, 32 bp, Artificial Sequence
  Synthetic polynucleotide
gaaggctgcactttaattttttttggagtgtt

SEQ ID NO: 10562 - DNA, 32 bp, Artificial Sequence
  Synthetic polynucleotide
gaaggctgcactttaagagccgattttttttt

SEQ ID NO: 10563 - DNA, 32 bp, Artificial Sequence
  Synthetic polynucleotide
ttttttttcttggtaacacaaaactgccaatg

SEQ ID NO: 10564 - DNA, 32 bp, Artificial Sequence
  Synthetic polynucleotide
cggcgccgttttttttcacaaaactgccaatg

SEQ ID NO: 10565 - DNA, 32 bp, Artificial Sequence
  Synthetic polynucleotide
cggcgccgcttggtaatttttttttgccaatg

SEQ ID NO: 10566 - DNA, 32 bp, Artificial Sequence
  Synthetic polynucleotide
cggcgccgcttggtaacacaaaactttttttt

SEQ ID NO: 10567 - DNA, 32 bp, Artificial Sequence
  Synthetic polynucleotide
tttttttttgatcaatatcggattccggcgga

SEQ ID NO: 10568 - DNA, 32 bp, Artificial Sequence
  Synthetic polynucleotide
ggttgcggttttttttatcggattccggcgga

SEQ ID NO: 10569 - DNA, 32 bp, Artificial Sequence
  Synthetic polynucleotide
ggttgcggtgatcaatttttttttccggcgga

SEQ ID NO: 10570 - DNA, 32 bp, Artificial Sequence
  Synthetic polynucleotide
ggttgcggtgatcaatatcggatttttttttt

SEQ ID NO: 10571 - DNA, 32 bp, Artificial Sequence
  Synthetic polynucleotide
ttttttttcacgtaaacaggtggtctctgata

SEQ ID NO: 10572 - DNA, 32 bp, Artificial Sequence
  Synthetic polynucleotide
cccggtggttttttttcaggtggtctctgata

SEQ ID NO: 10573 - DNA, 32 bp, Artificial Sequence
  Synthetic polynucleotide
cccggtggcacgtaaattttttttctctgata

SEQ ID NO: 10574 - DNA, 32 bp, Artificial Sequence
  Synthetic polynucleotide
cccggtggcacgtaaacaggtggttttttttt

SEQ ID NO: 10575 - DNA, 32 bp, Artificial Sequence
  Synthetic polynucleotide
ttttttttggaacagactgctttttataaaaa

SEQ ID NO: 10576 - DNA, 32 bp, Artificial Sequence
  Synthetic polynucleotide
gttgttccttttttttctgctttttataaaaa

SEQ ID NO: 10577 - DNA, 32 bp, Artificial Sequence
  Synthetic polynucleotide
gttgttccggaacagatttttttttataaaaa

SEQ ID NO: 10578 - DNA, 32 bp, Artificial Sequence
  Synthetic polynucleotide
gttgttccggaacagactgctttttttttttt

SEQ ID NO: 10579 - DNA, 32 bp, Artificial Sequence
  Synthetic polynucleotide
ttttttttcgggcatcagtcaatctccccgga

SEQ ID NO: 10580 - DNA, 32 bp, Artificial Sequence
  Synthetic polynucleotide
atgttccgttttttttagtcaatctccccgga

SEQ ID NO: 10581 - DNA, 32 bp, Artificial Sequence
  Synthetic polynucleotide
atgttccgcgggcatctttttttttccccgga

SEQ ID NO: 10582 - DNA, 32 bp, Artificial Sequence
  Synthetic polynucleotide
atgttccgcgggcatcagtcaatctttttttt

SEQ ID NO: 10583 - DNA, 32 bp, Artificial Sequence
  Synthetic polynucleotide
ttttttttcatcgtgccgtgggacattccacg

SEQ ID NO: 10584 - DNA, 32 bp, Artificial Sequence
  Synthetic polynucleotide
gcggcgaattttttttcgtgggacattccacg

SEQ ID NO: 10585 - DNA, 32 bp, Artificial Sequence
  Synthetic polynucleotide
gcggcgaacatcgtgcttttttttattccacg

SEQ ID NO: 10586 - DNA, 32 bp, Artificial Sequence
  Synthetic polynucleotide
gcggcgaacatcgtgccgtgggactttttttt

SEQ ID NO: 10587 - DNA, 32 bp, Artificial Sequence
  Synthetic polynucleotide
ttttttttaaaacgaccgggtataggagcgta

SEQ ID NO: 10588 - DNA, 32 bp, Artificial Sequence
  Synthetic polynucleotide
ctgctgaattttttttcgggtataggagcgta

SEQ ID NO: 10589 - DNA, 32 bp, Artificial Sequence
  Synthetic polynucleotide
ctgctgaaaaaacgacttttttttggagcgta

SEQ ID NO: 10590 - DNA, 32 bp, Artificial Sequence
  Synthetic polynucleotide
ctgctgaaaaaacgaccgggtatatttttttt

SEQ ID NO: 10591 - DNA, 32 bp, Artificial Sequence
  Synthetic polynucleotide
ttttttttgagtaagggctaagggttttgcat

SEQ ID NO: 10592 - DNA, 32 bp, Artificial Sequence
  Synthetic polynucleotide
gccaaaatttttttttgctaagggttttgcat

SEQ ID NO: 10593 - DNA, 32 bp, Artificial Sequence
  Synthetic polynucleotide
gccaaaatgagtaaggttttttttttttgcat

SEQ ID NO: 10594 - DNA, 32 bp, Artificial Sequence
  Synthetic polynucleotide
gccaaaatgagtaagggctaagggtttttttt

SEQ ID NO: 10595 - DNA, 32 bp, Artificial Sequence
  Synthetic polynucleotide
ttttttttccatgcgattgttgcggcctcgtg

SEQ ID NO: 10596 - DNA, 32 bp, Artificial Sequence
  Synthetic polynucleotide
gcgccagattttttttttgttgcggcctcgtg

SEQ ID NO: 10597 - DNA, 32 bp, Artificial Sequence
  Synthetic polynucleotide
gcgccagaccatgcgattttttttgcctcgtg

SEQ ID NO: 10598 - DNA, 32 bp, Artificial Sequence
  Synthetic polynucleotide
gcgccagaccatgcgattgttgcgtttttttt

SEQ ID NO: 10599 - DNA, 32 bp, Artificial Sequence
  Synthetic polynucleotide
ttttttttctaagccggacccaggtaggttat

SEQ ID NO: 10600 - DNA, 32 bp, Artificial Sequence
  Synthetic polynucleotide
ggcggatattttttttgacccaggtaggttat

SEQ ID NO: 10601 - DNA, 32 bp, Artificial Sequence
  Synthetic polynucleotide
ggcggatactaagccgtttttttttaggttat

SEQ ID NO: 10602 - DNA, 32 bp, Artificial Sequence
  Synthetic polynucleotide
ggcggatactaagccggacccaggtttttttt

SEQ ID NO: 10603 - DNA, 32 bp, Artificial Sequence
  Synthetic polynucleotide
ttttttttgcgagatatagatgcgactacacc

SEQ ID NO: 10604 - DNA, 32 bp, Artificial Sequence
  Synthetic polynucleotide
cgtcctgttttttttttagatgcgactacacc

SEQ ID NO: 10605 - DNA, 32 bp, Artificial Sequence
  Synthetic polynucleotide
cgtcctgtgcgagatattttttttactacacc

SEQ ID NO: 10606 - DNA, 32 bp, Artificial Sequence
  Synthetic polynucleotide
cgtcctgtgcgagatatagatgcgtttttttt

SEQ ID NO: 10607 - DNA, 32 bp, Artificial Sequence
  Synthetic polynucleotide
ttttttttgagaacattcacataccagctgga

SEQ ID NO: 10608 - DNA, 32 bp, Artificial Sequence
  Synthetic polynucleotide
cagagatgtttttttttcacataccagctgga

SEQ ID NO: 10609 - DNA, 32 bp, Artificial Sequence
  Synthetic polynucleotide
cagagatggagaacatttttttttcagctgga

SEQ ID NO: 10610 - DNA, 32 bp, Artificial Sequence
  Synthetic polynucleotide
cagagatggagaacattcacatactttttttt

SEQ ID NO: 10611 - DNA, 32 bp, Artificial Sequence
  Synthetic polynucleotide
ttttttttaacggtttagcgtgatgcaggcgt

SEQ ID NO: 10612 - DNA, 32 bp, Artificial Sequence
  Synthetic polynucleotide
atattgtattttttttagcgtgatgcaggcgt

SEQ ID NO: 10613 - DNA, 32 bp, Artificial Sequence
  Synthetic polynucleotide
atattgtaaacggtttttttttttgcaggcgt

SEQ ID NO: 10614 - DNA, 32 bp, Artificial Sequence
  Synthetic polynucleotide
atattgtaaacggtttagcgtgattttttttt

SEQ ID NO: 10615 - DNA, 32 bp, Artificial Sequence
  Synthetic polynucleotide
ttttttttatataactccatattaacctgcca

SEQ ID NO: 10616 - DNA, 32 bp, Artificial Sequence
  Synthetic polynucleotide
accttcaattttttttccatattaacctgcca

SEQ ID NO: 10617 - DNA, 32 bp, Artificial Sequence
  Synthetic polynucleotide
accttcaaatataactttttttttacctgcca

SEQ ID NO: 10618 - DNA, 32 bp, Artificial Sequence
  Synthetic polynucleotide
accttcaaatataactccatattatttttttt

SEQ ID NO: 10619 - DNA, 32 bp, Artificial Sequence
  Synthetic polynucleotide
tttttttttggttcaacgatgcgggcgagggt

SEQ ID NO: 10620 - DNA, 32 bp, Artificial Sequence
  Synthetic polynucleotide
gactctctttttttttcgatgcgggcgagggt

SEQ ID NO: 10621 - DNA, 32 bp, Artificial Sequence
  Synthetic polynucleotide
gactctcttggttcaattttttttgcgagggt

SEQ ID NO: 10622 - DNA, 32 bp, Artificial Sequence
  Synthetic polynucleotide
gactctcttggttcaacgatgcggtttttttt

SEQ ID NO: 10623 - DNA, 32 bp, Artificial Sequence
  Synthetic polynucleotide
ttttttttagggctgcgcatgagaggcgcaga

SEQ ID NO: 10624 - DNA, 32 bp, Artificial Sequence
  Synthetic polynucleotide
ctcaataattttttttgcatgagaggcgcaga

SEQ ID NO: 10625 - DNA, 32 bp, Artificial Sequence
  Synthetic polynucleotide
ctcaataaagggctgcttttttttggcgcaga

SEQ ID NO: 10626 - DNA, 32 bp, Artificial Sequence
  Synthetic polynucleotide
ctcaataaagggctgcgcatgagatttttttt

SEQ ID NO: 10627 - DNA, 32 bp, Artificial Sequence
  Synthetic polynucleotide
ttttttttttgcggggagtgtggtctgtttaa

SEQ ID NO: 10628 - DNA, 32 bp, Artificial Sequence
  Synthetic polynucleotide
ttgtgaacttttttttagtgtggtctgtttaa

SEQ ID NO: 10629 - DNA, 32 bp, Artificial Sequence
  Synthetic polynucleotide
ttgtgaacttgcggggttttttttctgtttaa

SEQ ID NO: 10630 - DNA, 32 bp, Artificial Sequence
  Synthetic polynucleotide
ttgtgaacttgcggggagtgtggttttttttt

SEQ ID NO: 10631 - DNA, 32 bp, Artificial Sequence
  Synthetic polynucleotide
tttttttttaacggccgactctaccctgggaa

SEQ ID NO: 10632 - DNA, 32 bp, Artificial Sequence
  Synthetic polynucleotide
ctgtactattttttttgactctaccctgggaa

SEQ ID NO: 10633 - DNA, 32 bp, Artificial Sequence
  Synthetic polynucleotide
ctgtactataacggccttttttttcctgggaa

SEQ ID NO: 10634 - DNA, 32 bp, Artificial Sequence
  Synthetic polynucleotide
ctgtactataacggccgactctactttttttt

SEQ ID NO: 10635 - DNA, 32 bp, Artificial Sequence
  Synthetic polynucleotide
ttttttttatcgctgacatcttaacgaccgtt

SEQ ID NO: 10636 - DNA, 32 bp, Artificial Sequence
  Synthetic polynucleotide
atcccctcttttttttcatcttaacgaccgtt

SEQ ID NO: 10637 - DNA, 32 bp, Artificial Sequence
  Synthetic polynucleotide
atcccctcatcgctgattttttttcgaccgtt

SEQ ID NO: 10638 - DNA, 32 bp, Artificial Sequence
  Synthetic polynucleotide
atcccctcatcgctgacatcttaatttttttt

SEQ ID NO: 10639 - DNA, 32 bp, Artificial Sequence
  Synthetic polynucleotide
ttttttttgtagttaaagaactcttgatgtcc

SEQ ID NO: 10640 - DNA, 32 bp, Artificial Sequence
  Synthetic polynucleotide
cgatagaattttttttagaactcttgatgtcc

SEQ ID NO: 10641 - DNA, 32 bp, Artificial Sequence
  Synthetic polynucleotide
cgatagaagtagttaatttttttttgatgtcc

SEQ ID NO: 10642 - DNA, 32 bp, Artificial Sequence
  Synthetic polynucleotide
cgatagaagtagttaaagaactcttttttttt

SEQ ID NO: 10643 - DNA, 32 bp, Artificial Sequence
  Synthetic polynucleotide
tttttttttcaccctacatacacaccacaatg

SEQ ID NO: 10644 - DNA, 32 bp, Artificial Sequence
  Synthetic polynucleotide
ttgtcttattttttttcatacacaccacaatg

SEQ ID NO: 10645 - DNA, 32 bp, Artificial Sequence
  Synthetic polynucleotide
ttgtcttatcaccctattttttttccacaatg

SEQ ID NO: 10646 - DNA, 32 bp, Artificial Sequence
  Synthetic polynucleotide
ttgtcttatcaccctacatacacatttttttt

SEQ ID NO: 10647 - DNA, 32 bp, Artificial Sequence
  Synthetic polynucleotide
ttttttttaccgtgggaaactgagtaagacct

SEQ ID NO: 10648 - DNA, 32 bp, Artificial Sequence
  Synthetic polynucleotide
tcatggtattttttttaaactgagtaagacct

SEQ ID NO: 10649 - DNA, 32 bp, Artificial Sequence
  Synthetic polynucleotide
tcatggtaaccgtgggtttttttttaagacct

SEQ ID NO: 10650 - DNA, 32 bp, Artificial Sequence
  Synthetic polynucleotide
tcatggtaaccgtgggaaactgagtttttttt

SEQ ID NO: 10651 - DNA, 32 bp, Artificial Sequence
  Synthetic polynucleotide
tttttttttggagtaggttagtggtggcaccc

SEQ ID NO: 10652 - DNA, 32 bp, Artificial Sequence
  Synthetic polynucleotide
cacttgacttttttttgttagtggtggcaccc

SEQ ID NO: 10653 - DNA, 32 bp, Artificial Sequence
  Synthetic polynucleotide
cacttgactggagtagtttttttttggcaccc

SEQ ID NO: 10654 - DNA, 32 bp, Artificial Sequence
  Synthetic polynucleotide
cacttgactggagtaggttagtggtttttttt

SEQ ID NO: 10655 - DNA, 32 bp, Artificial Sequence
  Synthetic polynucleotide
ttttttttgcgaccgatccctaaatgtccgtg

SEQ ID NO: 10656 - DNA, 32 bp, Artificial Sequence
  Synthetic polynucleotide
agacgccttttttttttccctaaatgtccgtg

SEQ ID NO: 10657 - DNA, 32 bp, Artificial Sequence
  Synthetic polynucleotide
agacgcctgcgaccgatttttttttgtccgtg

SEQ ID NO: 10658 - DNA, 32 bp, Artificial Sequence
  Synthetic polynucleotide
agacgcctgcgaccgatccctaaatttttttt

SEQ ID NO: 10659 - DNA, 32 bp, Artificial Sequence
  Synthetic polynucleotide
ttttttttggggatgatttgcaccacctatac

SEQ ID NO: 10660 - DNA, 32 bp, Artificial Sequence
  Synthetic polynucleotide
gctctggatttttttttttgcaccacctatac

SEQ ID NO: 10661 - DNA, 32 bp, Artificial Sequence
  Synthetic polynucleotide
gctctggaggggatgattttttttacctatac

SEQ ID NO: 10662 - DNA, 32 bp, Artificial Sequence
  Synthetic polynucleotide
gctctggaggggatgatttgcacctttttttt

SEQ ID NO: 10663 - DNA, 32 bp, Artificial Sequence
  Synthetic polynucleotide
tttttttttaggtgctaatattgcagtattcc

SEQ ID NO: 10664 - DNA, 32 bp, Artificial Sequence
  Synthetic polynucleotide
agacgtttttttttttaatattgcagtattcc

SEQ ID NO: 10665 - DNA, 32 bp, Artificial Sequence
  Synthetic polynucleotide
agacgttttaggtgctttttttttagtattcc

SEQ ID NO: 10666 - DNA, 32 bp, Artificial Sequence
  Synthetic polynucleotide
agacgttttaggtgctaatattgctttttttt

SEQ ID NO: 10667 - DNA, 48 bp, Artificial Sequence
  Synthetic polynucleotide
aactgttgtgtcctatgtttacttagggatggccaggttaagtggctc

SEQ ID NO: 10668 - DNA, 48 bp, Artificial Sequence
  Synthetic polynucleotide
gaagatagagagcataaattcgctaaaccggaaatcatactcacggtt

SEQ ID NO: 10669 - DNA, 48 bp, Artificial Sequence
  Synthetic polynucleotide
tacgaactcaacgcacaactgttgtgtcctatgtttacttagggatgg

SEQ ID NO: 10670 - DNA, 48 bp, Artificial Sequence
  Synthetic polynucleotide
gtgttcattcagagtagcggaaatatggccgcgctcgggtagtctcaa

SEQ ID NO: 10671 - DNA, 48 bp, Artificial Sequence
  Synthetic polynucleotide
gaagatagagagcatatacgaactcaacgcacgctcgggtagtctcaa

SEQ ID NO: 10672 - DNA, 48 bp, Artificial Sequence
  Synthetic polynucleotide
aaagtatccgcatctcgaagatagagagcataaattcgctaaaccgga

SEQ ID NO: 10673 - DNA, 48 bp, Artificial Sequence
  Synthetic polynucleotide
atcagcccgggcttttgctaatacgctgagcgactcagtgatcgagta

SEQ ID NO: 10674 - DNA, 48 bp, Artificial Sequence
  Synthetic polynucleotide
ttcatgtcgccttttcaaagtatccgcatctcactcagtgatcgagta

SEQ ID NO: 10675 - DNA, 48 bp, Artificial Sequence
  Synthetic polynucleotide
ttcggtgcgcagcggggtgttcattcagagtagcggaaatatggccgc

SEQ ID NO: 10676 - DNA, 48 bp, Artificial Sequence
  Synthetic polynucleotide
tctgatgcaccgggagccagccacttagctgtccgcctgtaacgctta

SEQ ID NO: 10677 - DNA, 48 bp, Artificial Sequence
  Synthetic polynucleotide
tacgaactcaacgcacgctcgggtagtctcaagctaatacgctgagcg

SEQ ID NO: 10678 - DNA, 48 bp, Artificial Sequence
  Synthetic polynucleotide
atcagcccgggcttttttcggtgcgcagcgggccgcctgtaacgctta

SEQ ID NO: 10679 - DNA, 48 bp, Artificial Sequence
  Synthetic polynucleotide
atgctgttgttgcgggatcagcccgggcttttgctaatacgctgagcg

SEQ ID NO: 10680 - DNA, 48 bp, Artificial Sequence
  Synthetic polynucleotide
gtgatgccaaaagggtggatatggagctggaagtttctgaaccggaac

SEQ ID NO: 10681 - DNA, 48 bp, Artificial Sequence
  Synthetic polynucleotide
aaagtatccgcatctcactcagtgatcgagtagtgaccccagagactg

SEQ ID NO: 10682 - DNA, 48 bp, Artificial Sequence
  Synthetic polynucleotide
ccgggctaatgaagccatgctgttgttgcggggtttctgaaccggaac

SEQ ID NO: 10683 - DNA, 48 bp, Artificial Sequence
  Synthetic polynucleotide
gtcagtgtgatcgcgatctgatgcaccgggagccagccacttagctgt

SEQ ID NO: 10684 - DNA, 48 bp, Artificial Sequence
  Synthetic polynucleotide
ggaaggattcatcccctttaagaatgatcgcagttccctctagctagg

SEQ ID NO: 10685 - DNA, 48 bp, Artificial Sequence
  Synthetic polynucleotide
ttcggtgcgcagcgggccgcctgtaacgcttaggatatggagctggaa

SEQ ID NO: 10686 - DNA, 48 bp, Artificial Sequence
  Synthetic polynucleotide
gtgatgccaaaagggtgtcagtgtgatcgcgagttccctctagctagg

SEQ ID NO: 10687 - DNA, 48 bp, Artificial Sequence
  Synthetic polynucleotide
cggctctgatttctaggtgatgccaaaagggtggatatggagctggaa

SEQ ID NO: 10688 - DNA, 48 bp, Artificial Sequence
  Synthetic polynucleotide
gcgtaaagatctcgcattctggtgccaaaacttgacctggtataatgg

SEQ ID NO: 10689 - DNA, 48 bp, Artificial Sequence
  Synthetic polynucleotide
atgctgttgttgcggggtttctgaaccggaaccaatcatacgtcccac

SEQ ID NO: 10690 - DNA, 48 bp, Artificial Sequence
  Synthetic polynucleotide
cggagctacctgacctcggctctgatttctagtgacctggtataatgg

SEQ ID NO: 10691 - DNA, 48 bp, Artificial Sequence
  Synthetic polynucleotide
cagtctttgagatgttggaaggattcatcccctttaagaatgatcgca

SEQ ID NO: 10692 - DNA, 48 bp, Artificial Sequence
  Synthetic polynucleotide
gcggctggacgaccccgccgtgcgacgactgagaacatcttttggttg

SEQ ID NO: 10693 - DNA, 48 bp, Artificial Sequence
  Synthetic polynucleotide
gtcagtgtgatcgcgagttccctctagctaggttctggtgccaaaact

SEQ ID NO: 10694 - DNA, 48 bp, Artificial Sequence
  Synthetic polynucleotide
gcgtaaagatctcgcacagtctttgagatgttgaacatcttttggttg

SEQ ID NO: 10695 - DNA, 48 bp, Artificial Sequence
  Synthetic polynucleotide
gccgactcgttcaagcgcgtaaagatctcgcattctggtgccaaaact

SEQ ID NO: 10696 - DNA, 48 bp, Artificial Sequence
  Synthetic polynucleotide
gacaaacgcatatcctcggcccgccaaattaaactattatctggctat

SEQ ID NO: 10697 - DNA, 48 bp, Artificial Sequence
  Synthetic polynucleotide
cggctctgatttctagtgacctggtataatggcccaagcttagcataa

SEQ ID NO: 10698 - DNA, 48 bp, Artificial Sequence
  Synthetic polynucleotide
aaaagatgtctgtcaggccgactcgttcaagcactattatctggctat

SEQ ID NO: 10699 - DNA, 48 bp, Artificial Sequence
  Synthetic polynucleotide
ccgtcgagccctgcgcgcggctggacgaccccgccgtgcgacgactga

SEQ ID NO: 10700 - DNA, 48 bp, Artificial Sequence
  Synthetic polynucleotide
cagtctttgagatgttgaacatcttttggttgcggcccgccaaattaa

SEQ ID NO: 10701 - DNA, 48 bp, Artificial Sequence
  Synthetic polynucleotide
tagtcgattacgcttcgacaaacgcatatcctcggcccgccaaattaa

SEQ ID NO: 10702 - DNA, 48 bp, Artificial Sequence
  Synthetic polynucleotide
gccgactcgttcaagcactattatctggctatacggtaatcgggggtg

SEQ ID NO: 10703 - DNA, 48 bp, Artificial Sequence
  Synthetic polynucleotide
tgacttggacgaggtttcactgggcgctatactatattagcttaccca

SEQ ID NO: 10704 - DNA, 48 bp, Artificial Sequence
  Synthetic polynucleotide
ccagcgaccacttctggagaaagatgcggtggctcgcgtggcacgtct

SEQ ID NO: 10705 - DNA, 48 bp, Artificial Sequence
  Synthetic polynucleotide
tgacttggacgaggttacgactcgtcgaacgaggactgttctacatag

SEQ ID NO: 10706 - DNA, 48 bp, Artificial Sequence
  Synthetic polynucleotide
aggaaactcgaggggctgacttggacgaggtttcactgggcgctatac

SEQ ID NO: 10707 - DNA, 48 bp, Artificial Sequence
  Synthetic polynucleotide
taactccaaaggaaaccagctatcccatattctccctgtctgtcgagc

SEQ ID NO: 10708 - DNA, 48 bp, Artificial Sequence
  Synthetic polynucleotide
ccagcgaccacttctgaggaaactcgaggggctccctgtctgtcgagc

SEQ ID NO: 10709 - DNA, 48 bp, Artificial Sequence
  Synthetic polynucleotide
cagtagttgtgattagccagcgaccacttctggagaaagatgcggtgg

SEQ ID NO: 10710 - DNA, 48 bp, Artificial Sequence
  Synthetic polynucleotide
gttcaaactagggggcttctgaccaaagctcacttgggggtgatatac

SEQ ID NO: 10711 - DNA, 48 bp, Artificial Sequence
  Synthetic polynucleotide
acgactcgtcgaacgaggactgttctacatagcagctatcccatattc

SEQ ID NO: 10712 - DNA, 48 bp, Artificial Sequence
  Synthetic polynucleotide
taactccaaaggaaacctcactaaactccttctaatgtgactaagcgt

SEQ ID NO: 10713 - DNA, 48 bp, Artificial Sequence
  Synthetic polynucleotide
gatgtaagcggacatctaactccaaaggaaaccagctatcccatattc

SEQ ID NO: 10714 - DNA, 48 bp, Artificial Sequence
  Synthetic polynucleotide
tatgcgacaccatgatccggatgagttatgaatatgcgcccgatatcc

SEQ ID NO: 10715 - DNA, 48 bp, Artificial Sequence
  Synthetic polynucleotide
aggaaactcgaggggctccctgtctgtcgagcttctgaccaaagctca

SEQ ID NO: 10716 - DNA, 48 bp, Artificial Sequence
  Synthetic polynucleotide
gttcaaactagggggcgatgtaagcggacatctatgcgcccgatatcc

SEQ ID NO: 10717 - DNA, 48 bp, Artificial Sequence
  Synthetic polynucleotide
tgagaattgtaaacaggttcaaactagggggcttctgaccaaagctca

SEQ ID NO: 10718 - DNA, 48 bp, Artificial Sequence
  Synthetic polynucleotide
agcatagcaccctgcgaagatagggtcacagcgaacagcttagagcag

SEQ ID NO: 10719 - DNA, 48 bp, Artificial Sequence
  Synthetic polynucleotide
ctcactaaactccttctaatgtgactaagcgtccggatgagttatgaa

SEQ ID NO: 10720 - DNA, 48 bp, Artificial Sequence
  Synthetic polynucleotide
tatgcgacaccatgattcaagttcggatacgctacctatggacgggga

SEQ ID NO: 10721 - DNA, 48 bp, Artificial Sequence; identical to SEQ ID NO: 4494
  Synthetic polynucleotide

SEQ ID NO: 10722 - DNA, 48 bp, Artificial Sequence
  Synthetic polynucleotide
cgtgtacctcgaaataatcgttagtttctcgatacaatctcgaagtaa

SEQ ID NO: 10723 - DNA, 48 bp, Artificial Sequence
  Synthetic polynucleotide
gatgtaagcggacatctatgcgcccgatatccaagatagggtcacagc

SEQ ID NO: 10724 - DNA, 48 bp, Artificial Sequence
  Synthetic polynucleotide
agcatagcaccctgcggatcgtcattgggatatacaatctcgaagtaa

SEQ ID NO: 10725 - DNA, 48 bp, Artificial Sequence
  Synthetic polynucleotide
agtaatacctctacctagcatagcaccctgcgaagatagggtcacagc

SEQ ID NO: 10726 - DNA, 48 bp, Artificial Sequence
  Synthetic polynucleotide
ttaacctatgccttggtaactgattttctccttgttggacgtaagcgt

SEQ ID NO: 10727 - DNA, 48 bp, Artificial Sequence
  Synthetic polynucleotide
tcaagttcggatacgctacctatggacggggaatcgttagtttctcga

SEQ ID NO: 10728 - DNA, 48 bp, Artificial Sequence
  Synthetic polynucleotide
cgtgtacctcgaaatagaaataacgaccagaaagcacgaggattatca

SEQ ID NO: 10729 - DNA, 48 bp, Artificial Sequence
  Synthetic polynucleotide
ctgttccgaaacaggccgtgtacctcgaaataatcgttagtttctcga

SEQ ID NO: 10730 - DNA, 48 bp, Artificial Sequence
  Synthetic polynucleotide
gggagagggtgaaacaggccacctggctcgggagcggtagcctcccac

SEQ ID NO: 10731 - DNA, 48 bp, Artificial Sequence
  Synthetic polynucleotide
gatcgtcattgggatatacaatctcgaagtaataactgattttctcct

SEQ ID NO: 10732 - DNA, 48 bp, Artificial Sequence
  Synthetic polynucleotide
ttaacctatgccttggctgttccgaaacaggcagcggtagcctcccac

SEQ ID NO: 10733 - DNA, 48 bp, Artificial Sequence
  Synthetic polynucleotide
ggttccgctagctgatttaacctatgccttggtaactgattttctcct

SEQ ID NO: 10734 - DNA, 48 bp, Artificial Sequence
  Synthetic polynucleotide
gccgcctcggttatactcgtcaagcctgctttctatggtccttaatat

SEQ ID NO: 10735 - DNA, 48 bp, Artificial Sequence
  Synthetic polynucleotide
gaaataacgaccagaaagcacgaggattatcaggccacctggctcggg

SEQ ID NO: 10736 - DNA, 48 bp, Artificial Sequence
  Synthetic polynucleotide
gagtgccccctcggcagggagagggtgaaacaggccacctggctcggg

SEQ ID NO: 10737 - DNA, 48 bp, Artificial Sequence
  Synthetic polynucleotide
ctgttccgaaacaggcagcggtagcctcccactcgtcaagcctgcttt

SEQ ID NO: 10738 - DNA, 48 bp, Artificial Sequence
  Synthetic polynucleotide
ccatagctaacccgatgccgcctcggttatactcgtcaagcctgcttt

SEQ ID NO: 10739 - DNA, 48 bp, Artificial Sequence
  Synthetic polynucleotide
acgtgggagtgcccgagcgtctgaggtatggttgtgcattccacgtga

SEQ ID NO: 10740 - DNA, 48 bp, Artificial Sequence
  Synthetic polynucleotide
actaattatccataactgtgcacgtcagggatgtcgtacttaaagcaa

SEQ ID NO: 10741 - DNA, 48 bp, Artificial Sequence
  Synthetic polynucleotide
ttacccactatgttgtacgtgggagtgcccgagcgtctgaggtatggt

SEQ ID NO: 10742 - DNA, 48 bp, Artificial Sequence
  Synthetic polynucleotide
ggtttggagggattaggcaattgctaggttgcctcaagtgctaacagt

SEQ ID NO: 10743 - DNA, 48 bp, Artificial Sequence; identical to SEQ ID NO: 5002
  Synthetic polynucleotide

SEQ ID NO: 10744 - DNA, 48 bp, Artificial Sequence
  Synthetic polynucleotide
tctcaccggtggccgtactaattatccataactgtgcacgtcagggat

SEQ ID NO: 10745 - DNA, 48 bp, Artificial Sequence
  Synthetic polynucleotide
catgggcaataaagctgtagcctgaggcgcgctgctacatcagtttct

SEQ ID NO: 10746 - DNA, 48 bp, Artificial Sequence
  Synthetic polynucleotide
ttgcactcctggggaatctcaccggtggccgttgctacatcagtttct

SEQ ID NO: 10747 - DNA, 48 bp, Artificial Sequence
  Synthetic polynucleotide
attgtaggcacaatttggtttggagggattaggcaattgctaggttgc

SEQ ID NO: 10748 - DNA, 48 bp, Artificial Sequence
  Synthetic polynucleotide
agtgggcgagatcggctaatcattagtgctccttgattcgatcacata

SEQ ID NO: 10749 - DNA, 48 bp, Artificial Sequence
  Synthetic polynucleotide
ttacccactatgttgtctcaagtgctaacagtgtagcctgaggcgcgc

SEQ ID NO: 10750 - DNA, 48 bp, Artificial Sequence
  Synthetic polynucleotide
catgggcaataaagctattgtaggcacaatttttgattcgatcacata

SEQ ID NO: 10751 - DNA, 48 bp, Artificial Sequence
  Synthetic polynucleotide
agctgcaccgtgtcaccatgggcaataaagctgtagcctgaggcgcgc

SEQ ID NO: 10752 - DNA, 48 bp, Artificial Sequence
  Synthetic polynucleotide
atgggctggtgccccacgtacagtaaccaacccttgatattgagggac

SEQ ID NO: 10753 - DNA, 48 bp, Artificial Sequence
  Synthetic polynucleotide
tctcaccggtggccgttgctacatcagtttctaaaccatactgagggc

SEQ ID NO: 10754 - DNA, 48 bp, Artificial Sequence
  Synthetic polynucleotide
acctcgtcattcggatagctgcaccgtgtcaccttgatattgagggac

SEQ ID NO: 10755 - DNA, 48 bp, Artificial Sequence
  Synthetic polynucleotide
cttagttagttcatagagtgggcgagatcggctaatcattagtgctcc

SEQ ID NO: 10756 - DNA, 48 bp, Artificial Sequence
  Synthetic polynucleotide
gaccagatctgctagaaaccaccaacatcctcttcattaggggcggaa

SEQ ID NO: 10757 - DNA, 48 bp, Artificial Sequence
  Synthetic polynucleotide
attgtaggcacaatttttgattcgatcacatacgtacagtaaccaacc

SEQ ID NO: 10758 - DNA, 48 bp, Artificial Sequence
  Synthetic polynucleotide
atgggctggtgccccacttagttagttcatagttcattaggggcggaa

SEQ ID NO: 10759 - DNA, 48 bp, Artificial Sequence
  Synthetic polynucleotide
ggtgtacctgtgggtaatgggctggtgccccacgtacagtaaccaacc

SEQ ID NO: 10760 - DNA, 48 bp, Artificial Sequence
  Synthetic polynucleotide
acagagctgaacttcccatggtcgttctactggggccgagcgctgggc

SEQ ID NO: 10761 - DNA, 48 bp, Artificial Sequence
  Synthetic polynucleotide
agctgcaccgtgtcaccttgatattgagggacaatatatgacttggtc

SEQ ID NO: 10762 - DNA, 48 bp, Artificial Sequence
  Synthetic polynucleotide
ttacatgtgcaagtgaggtgtacctgtgggtagggccgagcgctgggc

SEQ ID NO: 10763 - DNA, 48 bp, Artificial Sequence
  Synthetic polynucleotide
cttgacacctttcaatgaccagatctgctagaaaccaccaacatcctc

SEQ ID NO: 10764 - DNA, 48 bp, Artificial Sequence
  Synthetic polynucleotide
tgcattccaatgtttgatggccgcgtggcttattttagtaaacaccca

SEQ ID NO: 10765 - DNA, 48 bp, Artificial Sequence
  Synthetic polynucleotide
cttagttagttcatagttcattaggggcggaacatggtcgttctactg

SEQ ID NO: 10766 - DNA, 48 bp, Artificial Sequence
  Synthetic polynucleotide
acagagctgaacttcccttgacacctttcaatttttagtaaacaccca

SEQ ID NO: 10767 - DNA, 48 bp, Artificial Sequence
  Synthetic polynucleotide
tcgtatgatcataggaacagagctgaacttcccatggtcgttctactg

SEQ ID NO: 10768 - DNA, 48 bp, Artificial Sequence
  Synthetic polynucleotide
aaccacataaagtcgtccgcctccggtagtcatcaaactaaatacagc

SEQ ID NO: 10769 - DNA, 48 bp, Artificial Sequence
  Synthetic polynucleotide
ggtgtacctgtgggtagggccgagcgctgggctccttattggcgatcg

SEQ ID NO: 10770 - DNA, 48 bp, Artificial Sequence
  Synthetic polynucleotide
gtaccgccagttcttgtcgtatgatcataggatcaaactaaatacagc

SEQ ID NO: 10771 - DNA, 48 bp, Artificial Sequence
  Synthetic polynucleotide
ttaagacggccggtgttgcattccaatgtttgatggccgcgtggctta

SEQ ID NO: 10772 - DNA, 48 bp, Artificial Sequence
  Synthetic polynucleotide
cttgacacctttcaatttttagtaaacacccaccgcctccggtagtca

SEQ ID NO: 10773 - DNA, 48 bp, Artificial Sequence
  Synthetic polynucleotide
acgcggaacgtaatggaaccacataaagtcgtccgcctccggtagtca

SEQ ID NO: 10774 - DNA, 48 bp, Artificial Sequence
  Synthetic polynucleotide
tcgtatgatcataggatcaaactaaatacagcgacaaaaacagatttg

SEQ ID NO: 10775 - DNA, 48 bp, Artificial Sequence
  Synthetic polynucleotide
gtagtggccggccatcgtggactagaaagcgcacgtgcggcttctcct

SEQ ID NO: 10776 - DNA, 48 bp, Artificial Sequence
  Synthetic polynucleotide
gaaccagaaccatttaagagtaggggcagtgcgtatcgccttgtgtat

SEQ ID NO: 10777 - DNA, 48 bp, Artificial Sequence; identical to SEQ ID NO: 3940
  Synthetic polynucleotide

SEQ ID NO: 10778 - DNA, 48 bp, Artificial Sequence
  Synthetic polynucleotide
cggcaatctgaatatcgtagtggccggccatcgtggactagaaagcgc

SEQ ID NO: 10779 - DNA, 48 bp, Artificial Sequence
  Synthetic polynucleotide
tcatgtgggatcctaaagtttctggtagacctgctacctccgatacgc

SEQ ID NO: 10780 - DNA, 48 bp, Artificial Sequence
  Synthetic polynucleotide
gaaccagaaccatttacggcaatctgaatatcgctacctccgatacgc

SEQ ID NO: 10781 - DNA, 48 bp, Artificial Sequence; identical to SEQ ID NO: 4063
  Synthetic polynucleotide

SEQ ID NO: 10782 - DNA, 48 bp, Artificial Sequence
  Synthetic polynucleotide
tcgtttactgcacggaacgagagtgctggcatacatctcggaaaggtg

SEQ ID NO: 10783 - DNA, 48 bp, Artificial Sequence
  Synthetic polynucleotide
tatactcttgcgggggggtcgagcgctccactagtttctggtagacct

SEQ ID NO: 10784 - DNA, 48 bp, Artificial Sequence; identical to SEQ ID NO: 3295
  Synthetic polynucleotide

SEQ ID NO: 10785 - DNA, 48 bp, Artificial Sequence; identical to SEQ ID NO: 4180
  Synthetic polynucleotide

SEQ ID NO: 10786 - DNA, 48 bp, Artificial Sequence
  Synthetic polynucleotide
cgaacgagatcgtcctagacgacggatctcctgatatccacggtacat

SEQ ID NO: 10787 - DNA, 48 bp, Artificial Sequence
  Synthetic polynucleotide
cggcaatctgaatatcgctacctccgatacgcacgagagtgctggcat

SEQ ID NO: 10788 - DNA, 48 bp, Artificial Sequence
  Synthetic polynucleotide
tcgtttactgcacggacgtaggctagagcggtgatatccacggtacat

SEQ ID NO: 10789 - DNA, 48 bp, Artificial Sequence; identical to SEQ ID NO: 3343
  Synthetic polynucleotide

SEQ ID NO: 10790 - DNA, 48 bp, Artificial Sequence
  Synthetic polynucleotide
tttaacgctttagacccagcttgacgcaagacacttggggactaagat

SEQ ID NO: 10791 - DNA, 48 bp, Artificial Sequence
  Synthetic polynucleotide
tcccaagtgcaagtaaaaaaggaattatgagaagacgacggatctcct

SEQ ID NO: 10792 - DNA, 48 bp, Artificial Sequence
  Synthetic polynucleotide
cgaacgagatcgtcctcgttgcgaattttcgcgcgattcgcatgtagc

SEQ ID NO: 10793 - DNA, 48 bp, Artificial Sequence; identical to SEQ ID NO: 3393
  Synthetic polynucleotide

SEQ ID NO: 10794 - DNA, 48 bp, Artificial Sequence
  Synthetic polynucleotide
caagttcctgcggcggctgtacgaatgagtccgtcaaatatgcgtgct

SEQ ID NO: 10795 - DNA, 48 bp, Artificial Sequence
  Synthetic polynucleotide
cgtaggctagagcggtgatatccacggtacatcagcttgacgcaagac

SEQ ID NO: 10796 - DNA, 48 bp, Artificial Sequence
  Synthetic polynucleotide
tttaacgctttagaccgcatgccggtagcaccgtcaaatatgcgtgct

SEQ ID NO: 10797 - DNA, 48 bp, Artificial Sequence
  Synthetic polynucleotide
gctaatcactgggcagtttaacgctttagacccagcttgacgcaagac

SEQ ID NO: 10798 - DNA, 48 bp, Artificial Sequence
  Synthetic polynucleotide
caccagcaggatgtcgagcccacaacttgacaggtcctaggttgcaga

SEQ ID NO: 10799 - DNA, 48 bp, Artificial Sequence
  Synthetic polynucleotide
cgttgcgaattttcgcgcgattcgcatgtagcctgtacgaatgagtcc

SEQ ID NO: 10800 - DNA, 48 bp, Artificial Sequence
  Synthetic polynucleotide
caagttcctgcggcggaacctaccccctaagcagcgtagtaagggtta

SEQ ID NO: 10801 - DNA, 48 bp, Artificial Sequence
  Synthetic polynucleotide
ggccttgacatgacatcaagttcctgcggcggctgtacgaatgagtcc

SEQ ID NO: 10802 - DNA, 48 bp, Artificial Sequence
  Synthetic polynucleotide
tgcgtacggcttttatatagcgtagaccggactctcccacccgtccaa

SEQ ID NO: 10803 - DNA, 48 bp, Artificial Sequence
  Synthetic polynucleotide
gcatgccggtagcaccgtcaaatatgcgtgctagcccacaacttgaca

SEQ ID NO: 10804 - DNA, 48 bp, Artificial Sequence; identical to SEQ ID NO: 3489
  Synthetic polynucleotide

SEQ ID NO: 10805 - DNA, 48 bp, Artificial Sequence
  Synthetic polynucleotide
gtagtacagtatctttcaccagcaggatgtcgagcccacaacttgaca

SEQ ID NO: 10806 - DNA, 48 bp, Artificial Sequence
  Synthetic polynucleotide
agagtcgttatgccccccggttctgctagagttttcatggcggcgatg

SEQ ID NO: 10807 - DNA, 48 bp, Artificial Sequence
  Synthetic polynucleotide
aacctaccccctaagcagcgtagtaagggttaatagcgtagaccggac

SEQ ID NO: 10808 - DNA, 48 bp, Artificial Sequence
  Synthetic polynucleotide
aaccccgtaaatcgtatgcgtacggcttttatatagcgtagaccggac

SEQ ID NO: 10809 - DNA, 48 bp, Artificial Sequence
  Synthetic polynucleotide
ggccttgacatgacattctcccacccgtccaaccggttctgctagagt

SEQ ID NO: 10810 - DNA, 48 bp, Artificial Sequence
  Synthetic polynucleotide
gggactggatcagatgagagtcgttatgccccccggttctgctagagt

SEQ ID NO: 10811 - DNA, 48 bp, Artificial Sequence
  Synthetic polynucleotide
cgcgcttaccaagtaacgtatgtacgacgcgattcaagtattcggtga

SEQ ID NO: 10812 - DNA, 48 bp, Artificial Sequence
  Synthetic polynucleotide
ggccaggcgatctaagtctggcgcgtgaggaccctccccgcattacaa

SEQ ID NO: 10813 - DNA, 48 bp, Artificial Sequence; identical to SEQ ID NO: 3609
  Synthetic polynucleotide

SEQ ID NO: 10814 - DNA, 48 bp, Artificial Sequence
  Synthetic polynucleotide
cggactgcattctggacagtaactgcattaacgatgaatttcgttcgg

SEQ ID NO: 10815 - DNA, 48 bp, Artificial Sequence
  Synthetic polynucleotide
ggccaggcgatctaagtgcgagtgaacgggtggatgaatttcgttcgg

SEQ ID NO: 10816 - DNA, 48 bp, Artificial Sequence
  Synthetic polynucleotide
acgtaagttgaagtagggccaggcgatctaagtctggcgcgtgaggac

SEQ ID NO: 10817 - DNA, 48 bp, Artificial Sequence
  Synthetic polynucleotide
agttgaaaattatctcgataagcagaaggaccgaagctttttctagcc

SEQ ID NO: 10818 - DNA, 48 bp, Artificial Sequence
  Synthetic polynucleotide
atagcatcgacactacacgtaagttgaagtaggaagctttttctagcc

SEQ ID NO: 10819 - DNA, 48 bp, Artificial Sequence
  Synthetic polynucleotide
tacgtgctcccaacatcggactgcattctggacagtaactgcattaac

SEQ ID NO: 10820 - DNA, 48 bp, Artificial Sequence
  Synthetic polynucleotide
aacggtttcccggacctagtgtctatcaagtcaagtgacgtcctcagc

SEQ ID NO: 10821 - DNA, 48 bp, Artificial Sequence
  Synthetic polynucleotide
tgcgagtgaacgggtggatgaatttcgttcgggataagcagaaggacc

SEQ ID NO: 10822 - DNA, 48 bp, Artificial Sequence
  Synthetic polynucleotide
agttgaaaattatctctacgtgctcccaacataagtgacgtcctcagc

SEQ ID NO: 10823 - DNA, 48 bp, Artificial Sequence
  Synthetic polynucleotide
tgtataactggcaagaagttgaaaattatctcgataagcagaaggacc

SEQ ID NO: 10824 - DNA, 48 bp, Artificial Sequence
  Synthetic polynucleotide
tcactgttgtgacctacgagaagcgtatagatgacaaggccgcttcag

SEQ ID NO: 10825 - DNA, 48 bp, Artificial Sequence
  Synthetic polynucleotide
acgtaagttgaagtaggaagctttttctagccgtattaatgccgcgcc

SEQ ID NO: 10826 - DNA, 48 bp, Artificial Sequence
  Synthetic polynucleotide
aaaggatagccggacctgtataactggcaagagacaaggccgcttcag

SEQ ID NO: 10827 - DNA, 48 bp, Artificial Sequence
  Synthetic polynucleotide
tattctatgaaaccataacggtttcccggacctagtgtctatcaagtc

SEQ ID NO: 10828 - DNA, 48 bp, Artificial Sequence
  Synthetic polynucleotide
atacgacaggtggcaaaccacctccgatgtcatctcgggtcgagcggg

SEQ ID NO: 10829 - DNA, 48 bp, Artificial Sequence
  Synthetic polynucleotide
tacgtgctcccaacataagtgacgtcctcagccgagaagcgtatagat

SEQ ID NO: 10830 - DNA, 48 bp, Artificial Sequence
  Synthetic polynucleotide
tcactgttgtgacctatattctatgaaaccattctcgggtcgagcggg

SEQ ID NO: 10831 - DNA, 48 bp, Artificial Sequence
  Synthetic polynucleotide
gttccgcgcgaatagctcactgttgtgacctacgagaagcgtatagat

SEQ ID NO: 10832 - DNA, 48 bp, Artificial Sequence
  Synthetic polynucleotide
accgaggattcgcaggtccatgggattcaccatcacaggcgaactacg

SEQ ID NO: 10833 - DNA, 48 bp, Artificial Sequence
  Synthetic polynucleotide
tgtataactggcaagagacaaggccgcttcagcgctcctcgggaatta

SEQ ID NO: 10834 - DNA, 48 bp, Artificial Sequence
  Synthetic polynucleotide
tatgaattggtttaaagttccgcgcgaatagctcacaggcgaactacg

SEQ ID NO: 10835 - DNA, 48 bp, Artificial Sequence
  Synthetic polynucleotide
gcgccgcatacccattatacgacaggtggcaaaccacctccgatgtca

SEQ ID NO: 10836 - DNA, 48 bp, Artificial Sequence
  Synthetic polynucleotide
attagtgtacccagcagttcggctcccttgtgcactgtgaatttccac

SEQ ID NO: 10837 - DNA, 48 bp, Artificial Sequence
  Synthetic polynucleotide
tattctatgaaaccattctcgggtcgagcgggtccatgggattcacca

SEQ ID NO: 10838 - DNA, 48 bp, Artificial Sequence
  Synthetic polynucleotide
accgaggattcgcagggcgccgcatacccattcactgtgaatttccac

SEQ ID NO: 10839 - DNA, 48 bp, Artificial Sequence; identical to SEQ ID NO: 5265
  Synthetic polynucleotide

SEQ ID NO: 10840 - DNA, 48 bp, Artificial Sequence
  Synthetic polynucleotide
tcgtcgtgtaatgctgttccggggtaaatcaagattctccatggcagc

SEQ ID NO: 10841 - DNA, 48 bp, Artificial Sequence
  Synthetic polynucleotide
gttccgcgcgaatagctcacaggcgaactacggaactggtagatcacc

SEQ ID NO: 10842 - DNA, 48 bp, Artificial Sequence
  Synthetic polynucleotide
gcttcggtacaggtctagctcgtatacaccctgattctccatggcagc

SEQ ID NO: 10843 - DNA, 48 bp, Artificial Sequence
  Synthetic polynucleotide
gactcgggatacccggattagtgtacccagcagttcggctcccttgtg

SEQ ID NO: 10844 - DNA, 48 bp, Artificial Sequence
  Synthetic polynucleotide
gcgccgcatacccattcactgtgaatttccacttccggggtaaatcaa

SEQ ID NO: 10845 - DNA, 48 bp, Artificial Sequence
  Synthetic polynucleotide
gctttataaattcccgtcgtcgtgtaatgctgttccggggtaaatcaa

SEQ ID NO: 10846 - DNA, 48 bp, Artificial Sequence
  Synthetic polynucleotide
agctcgtatacaccctgattctccatggcagctttagagcccggccgt

SEQ ID NO: 10847 - DNA, 48 bp, Artificial Sequence
  Synthetic polynucleotide
ctactggcgttttcatatatcagagagcacagaaaaccaggcgcaatc

SEQ ID NO: 10848 - DNA, 48 bp, Artificial Sequence
  Synthetic polynucleotide
tcatatggacacaccagattacggcggcttagtcatggcataaacgaa

SEQ ID NO: 10849 - DNA, 48 bp, Artificial Sequence
  Synthetic polynucleotide
ctactggcgttttcatacccaatcatacgagcgtggagggaagttatt

SEQ ID NO: 10850 - DNA, 48 bp, Artificial Sequence
  Synthetic polynucleotide
taattcggagcccggcctactggcgttttcatatatcagagagcacag

SEQ ID NO: 10851 - DNA, 48 bp, Artificial Sequence
  Synthetic polynucleotide
aaatgttggctgagattgattggtttagtgtagtattatcgcgtcaat

SEQ ID NO: 10852 - DNA, 48 bp, Artificial Sequence
  Synthetic polynucleotide
tcatatggacacaccataattcggagcccggcgtattatcgcgtcaat

SEQ ID NO: 10853 - DNA, 48 bp, Artificial Sequence
  Synthetic polynucleotide
gggaattgagtacaagtcatatggacacaccagattacggcggcttag

SEQ ID NO: 10854 - DNA, 48 bp, Artificial Sequence
  Synthetic polynucleotide
caggatcaaagttgactagcagaataatttgctgacgaagaataccgt

SEQ ID NO: 10855 - DNA, 48 bp, Artificial Sequence
  Synthetic polynucleotide
acccaatcatacgagcgtggagggaagttatttgattggtttagtgta

SEQ ID NO: 10856 - DNA, 48 bp, Artificial Sequence
  Synthetic polynucleotide
aaatgttggctgagatccatcagatggagctgtcaggcttctccgtca

SEQ ID NO: 10857 - DNA, 48 bp, Artificial Sequence
  Synthetic polynucleotide
tagcgagtaagagataaaatgttggctgagattgattggtttagtgta

SEQ ID NO: 10858 - DNA, 48 bp, Artificial Sequence
  Synthetic polynucleotide
acgagccaccacctagcacctcctgttagggttgtgggaggatcatta

SEQ ID NO: 10859 - DNA, 48 bp, Artificial Sequence
  Synthetic polynucleotide
taattcggagcccggcgtattatcgcgtcaattagcagaataatttgc

SEQ ID NO: 10860 - DNA, 48 bp, Artificial Sequence; identical to SEQ ID NO: 4495
  Synthetic polynucleotide

SEQ ID NO: 10861 - DNA, 48 bp, Artificial Sequence
  Synthetic polynucleotide
atccgaataaggtacgcaggatcaaagttgactagcagaataatttgc

SEQ ID NO: 10862 - DNA, 48 bp, Artificial Sequence
  Synthetic polynucleotide
cagttttcgcttgaggaatagtccaagaaatgcaattactatttgtac

SEQ ID NO: 10863 - DNA, 48 bp, Artificial Sequence
  Synthetic polynucleotide
ccatcagatggagctgtcaggcttctccgtcacacctcctgttagggt

SEQ ID NO: 10864 - DNA, 48 bp, Artificial Sequence; identical to SEQ ID NO: 4703
  Synthetic polynucleotide

SEQ ID NO: 10865 - DNA, 48 bp, Artificial Sequence
  Synthetic polynucleotide
gacacccgggatgggtacgagccaccacctagcacctcctgttagggt

SEQ ID NO: 10866 - DNA, 48 bp, Artificial Sequence
  Synthetic polynucleotide
gctcggtagaccatgtctccagtattgccatttgttcatcggtcaccc

SEQ ID NO: 10867 - DNA, 48 bp, Artificial Sequence
  Synthetic polynucleotide
tagcgagtaagagatatgtgggaggatcattaaatagtccaagaaatg

SEQ ID NO: 10868 - DNA, 48 bp, Artificial Sequence
  Synthetic polynucleotide
cagttttcgcttgagggacacccgggatgggttgttcatcggtcaccc

SEQ ID NO: 10869 - DNA, 48 bp, Artificial Sequence
  Synthetic polynucleotide
catgataaaagttgtgcagttttcgcttgaggaatagtccaagaaatg

SEQ ID NO: 10870 - DNA, 48 bp, Artificial Sequence
  Synthetic polynucleotide
gatcagcgaattcgacacaatggtatcttttgccgcactggaatctga

SEQ ID NO: 10871 - DNA, 48 bp, Artificial Sequence
  Synthetic polynucleotide
cgaaaacaagggcatacagtaacgaaaagcgactccagtattgccatt

SEQ ID NO: 10872 - DNA, 48 bp, Artificial Sequence
  Synthetic polynucleotide
gctcggtagaccatgtagatgcaccggttctcgagacactcatttact

SEQ ID NO: 10873 - DNA, 48 bp, Artificial Sequence
  Synthetic polynucleotide
ttctaattaatactttgctcggtagaccatgtctccagtattgccatt

SEQ ID NO: 10874 - DNA, 48 bp, Artificial Sequence
  Synthetic polynucleotide
atataggtctgacacccagctcccaggtaagttaatataatgtccgcg

SEQ ID NO: 10875 - DNA, 48 bp, Artificial Sequence
  Synthetic polynucleotide
gacacccgggatgggttgttcatcggtcacccacaatggtatcttttg

SEQ ID NO: 10876 - DNA, 48 bp, Artificial Sequence
  Synthetic polynucleotide
gatcagcgaattcgacttctaattaatacttttaatataatgtccgcg

SEQ ID NO: 10877 - DNA, 48 bp, Artificial Sequence
  Synthetic polynucleotide
aagcgcacgtaaaccggatcagcgaattcgacacaatggtatcttttg

SEQ ID NO: 10878 - DNA, 48 bp, Artificial Sequence
  Synthetic polynucleotide
aatggtcgacaatatgtattaagttttcgccgcttgcctgggccaata

SEQ ID NO: 10879 - DNA, 48 bp, Artificial Sequence
  Synthetic polynucleotide
agatgcaccggttctcgagacactcatttactcagctcccaggtaagt

SEQ ID NO: 10880 - DNA, 48 bp, Artificial Sequence
  Synthetic polynucleotide
gcggagagaaatggctatataggtctgacacccagctcccaggtaagt

SEQ ID NO: 10881 - DNA, 48 bp, Artificial Sequence
  Synthetic polynucleotide
ttctaattaatacttttaatataatgtccgcgtattaagttttcgccg

SEQ ID NO: 10882 - DNA, 48 bp, Artificial Sequence
  Synthetic polynucleotide
tgagcgatcaatgaccaatggtcgacaatatgtattaagttttcgccg

SEQ ID NO: 10883 - DNA, 48 bp, Artificial Sequence
  Synthetic polynucleotide
cttctacctcttaatgtataattcatcctgtgccagtaatagcctgaa

SEQ ID NO: 10884 - DNA, 48 bp, Artificial Sequence
  Synthetic polynucleotide
gttaccgctataattaagaacattcgggttcgcaccctgcatcgacgg

SEQ ID NO: 10885 - DNA, 48 bp, Artificial Sequence
  Synthetic polynucleotide
catggaagcagagttccttctacctcttaatgtataattcatcctgtg

SEQ ID NO: 10886 - DNA, 48 bp, Artificial Sequence
  Synthetic polynucleotide
aagtgttaatgccgagatctaacttgatttttccatcggcaaaattga

SEQ ID NO: 10887 - DNA, 48 bp, Artificial Sequence
  Synthetic polynucleotide
gttaccgctataattacatggaagcagagttcccatcggcaaaattga

SEQ ID NO: 10888 - DNA, 48 bp, Artificial Sequence
  Synthetic polynucleotide
acgtggtctatgtgatgttaccgctataattaagaacattcgggttcg

SEQ ID NO: 10889 - DNA, 48 bp, Artificial Sequence
  Synthetic polynucleotide
cattctatagcccgcggttactaggcgccttgcgcctaggctaacctc

SEQ ID NO: 10890 - DNA, 48 bp, Artificial Sequence
  Synthetic polynucleotide
atgactccaggagaggacgtggtctatgtgatcgcctaggctaacctc

SEQ ID NO: 10891 - DNA, 48 bp, Artificial Sequence
  Synthetic polynucleotide
attcagaatcgagaccaagtgttaatgccgagatctaacttgattttt

SEQ ID NO: 10892 - DNA, 48 bp, Artificial Sequence
  Synthetic polynucleotide
agctctagaggggaaccgtagacttcacataattgctcttggacgtct

SEQ ID NO: 10893 - DNA, 48 bp, Artificial Sequence
  Synthetic polynucleotide
catggaagcagagttcccatcggcaaaattgagttactaggcgccttg

SEQ ID NO: 10894 - DNA, 48 bp, Artificial Sequence
  Synthetic polynucleotide
cattctatagcccgcgattcagaatcgagaccttgctcttggacgtct

SEQ ID NO: 10895 - DNA, 48 bp, Artificial Sequence
  Synthetic polynucleotide
ctcctacgctcaatagcattctatagcccgcggttactaggcgccttg

SEQ ID NO: 10896 - DNA, 48 bp, Artificial Sequence
  Synthetic polynucleotide
atggtacacccagcattccttcagtccgcctatgaacccttactatcg

SEQ ID NO: 10897 - DNA, 48 bp, Artificial Sequence
  Synthetic polynucleotide
acgtggtctatgtgatcgcctaggctaacctcaataaacgatacttaa

SEQ ID NO: 10898 - DNA, 48 bp, Artificial Sequence
  Synthetic polynucleotide
cgacaggataggtcaactcctacgctcaatagtgaacccttactatcg

SEQ ID NO: 10899 - DNA, 48 bp, Artificial Sequence
  Synthetic polynucleotide
aaaacactcggcgagtagctctagaggggaaccgtagacttcacataa

SEQ ID NO: 10900 - DNA, 48 bp, Artificial Sequence
  Synthetic polynucleotide
tcatacagcattgtctaccacctatgttcttagttctagggagcgggg

SEQ ID NO: 10901 - DNA, 48 bp, Artificial Sequence
  Synthetic polynucleotide
attcagaatcgagaccttgctcttggacgtcttccttcagtccgccta

SEQ ID NO: 10902 - DNA, 48 bp, Artificial Sequence
  Synthetic polynucleotide
atggtacacccagcataaaacactcggcgagtgttctagggagcgggg

SEQ ID NO: 10903 - DNA, 48 bp, Artificial Sequence
  Synthetic polynucleotide
ctcatgatctttgataatggtacacccagcattccttcagtccgccta

SEQ ID NO: 10904 - DNA, 48 bp, Artificial Sequence
  Synthetic polynucleotide
taaggtggggccgaccaccgaccaaggcgctattctcccaaatggata

SEQ ID NO: 10905 - DNA, 48 bp, Artificial Sequence
  Synthetic polynucleotide
ctcctacgctcaatagtgaacccttactatcgcttgcctatcgtgccc

SEQ ID NO: 10906 - DNA, 48 bp, Artificial Sequence
  Synthetic polynucleotide
gggcgtaaacaaaaaactcatgatctttgatattctcccaaatggata

SEQ ID NO: 10907 - DNA, 48 bp, Artificial Sequence
  Synthetic polynucleotide
tgctgttaacatagattcatacagcattgtctaccacctatgttctta

SEQ ID NO: 10908 - DNA, 48 bp, Artificial Sequence
  Synthetic polynucleotide
tccgtccgttggagcccacgaaccaacgcatccgtcgggcgaccttcg

SEQ ID NO: 10909 - DNA, 48 bp, Artificial Sequence
  Synthetic polynucleotide
aaaacactcggcgagtgttctagggagcggggaccgaccaaggcgcta

SEQ ID NO: 10910 - DNA, 48 bp, Artificial Sequence
  Synthetic polynucleotide
taaggtggggccgacctgctgttaacatagatcgtcgggcgaccttcg

SEQ ID NO: 10911 - DNA, 48 bp, Artificial Sequence
  Synthetic polynucleotide
tagggtatactcgtaataaggtggggccgaccaccgaccaaggcgcta

SEQ ID NO: 10912 - DNA, 48 bp, Artificial Sequence
  Synthetic polynucleotide
accattaccggaggcgcattaggtctattatagcgatatctgaatgcg

SEQ ID NO: 10913 - DNA, 48 bp, Artificial Sequence
  Synthetic polynucleotide
ctcatgatctttgatattctcccaaatggataaaaataccttcgccgg

SEQ ID NO: 10914 - DNA, 48 bp, Artificial Sequence
  Synthetic polynucleotide
taatacgaaacgacaatagggtatactcgtaagcgatatctgaatgcg

SEQ ID NO: 10915 - DNA, 48 bp, Artificial Sequence
  Synthetic polynucleotide
cttagtgctgtagttttccgtccgttggagcccacgaaccaacgcatc

SEQ ID NO: 10916 - DNA, 48 bp, Artificial Sequence
  Synthetic polynucleotide
tgctgttaacatagatcgtcgggcgaccttcgcattaggtctattata

SEQ ID NO: 10917 - DNA, 48 bp, Artificial Sequence
  Synthetic polynucleotide
atgggacgccactacgaccattaccggaggcgcattaggtctattata

SEQ ID NO: 10918 - DNA, 48 bp, Artificial Sequence
  Synthetic polynucleotide
tagggtatactcgtaagcgatatctgaatgcgggcactgtcacggcgc

SEQ ID NO: 10919 - DNA, 48 bp, Artificial Sequence
  Synthetic polynucleotide
taatatggggattacccttcaataagttgtaggatgacctcgcagcct

SEQ ID NO: 10920 - DNA, 48 bp, Artificial Sequence
  Synthetic polynucleotide
tctcatgcgaagcaggatgtgtaatggtgggcggcacagcttggcgat

SEQ ID NO: 10921 - DNA, 48 bp, Artificial Sequence
  Synthetic polynucleotide
taatatggggattaccatatcatctacaatgtgtctgacccttcacat

SEQ ID NO: 10922 - DNA, 48 bp, Artificial Sequence; identical to SEQ ID NO: 4154
  Synthetic polynucleotide

SEQ ID NO: 10923 - DNA, 48 bp, Artificial Sequence
  Synthetic polynucleotide
cctgggtcctgctgccgccctttggggttcacgccatcctacccgctt

SEQ ID NO: 10924 - DNA, 48 bp, Artificial Sequence
  Synthetic polynucleotide
tctcatgcgaagcagggcatcagctggcaggtgccatcctacccgctt

SEQ ID NO: 10925 - DNA, 48 bp, Artificial Sequence
  Synthetic polynucleotide
ggacgatatctgcgcctctcatgcgaagcaggatgtgtaatggtgggc

SEQ ID NO: 10926 - DNA, 48 bp, Artificial Sequence
  Synthetic polynucleotide
gtatgtgaaagagtcaagcgtaaagtcttgacagcgccacgtccccaa

SEQ ID NO: 10927 - DNA, 48 bp, Artificial Sequence
  Synthetic polynucleotide
atatcatctacaatgtgtctgacccttcacatgccctttggggttcac

SEQ ID NO: 10928 - DNA, 48 bp, Artificial Sequence; identical to SEQ ID NO: 5175
  Synthetic polynucleotide

SEQ ID NO: 10929 - DNA, 48 bp, Artificial Sequence
  Synthetic polynucleotide
gcccgcgcataacctacctgggtcctgctgccgccctttggggttcac

SEQ ID NO: 10930 - DNA, 48 bp, Artificial Sequence
  Synthetic polynucleotide
gtcccacgtctttaaatgtcccgtgttagggcagtaatgtctagtgcc

SEQ ID NO: 10931 - DNA, 48 bp, Artificial Sequence
  Synthetic polynucleotide
gcatcagctggcaggtgccatcctacccgcttagcgtaaagtcttgac

SEQ ID NO: 10932 - DNA, 48 bp, Artificial Sequence; identical to SEQ ID NO: 4656
  Synthetic polynucleotide

SEQ ID NO: 10933 - DNA, 48 bp, Artificial Sequence
  Synthetic polynucleotide
gtattccatccagctggtatgtgaaagagtcaagcgtaaagtcttgac

SEQ ID NO: 10934 - DNA, 48 bp, Artificial Sequence
  Synthetic polynucleotide
cccttagccgtacaaagcgttactgacccgctacggtatggaaagaag

SEQ ID NO: 10935 - DNA, 48 bp, Artificial Sequence
  Synthetic polynucleotide
ttgtcgggacctgtcattggagtgatgaacaatgtcccgtgttagggc

SEQ ID NO: 10936 - DNA, 48 bp, Artificial Sequence
  Synthetic polynucleotide
gtcccacgtctttaaacgaaggggctcgagtctacagcagagctacgc

SEQ ID NO: 10937 - DNA, 48 bp, Artificial Sequence
  Synthetic polynucleotide
tcgcatctcgtggaatgtcccacgtctttaaatgtcccgtgttagggc

SEQ ID NO: 10938 - DNA, 48 bp, Artificial Sequence
  Synthetic polynucleotide
aatccgatgaccctaagagtccccgaagaataccattcagttcacagg

SEQ ID NO: 10939 - DNA, 48 bp, Artificial Sequence
  Synthetic polynucleotide
gcccgcgcataacctaagtaatgtctagtgccgcgttactgacccgct

SEQ ID NO: 10940 - DNA, 48 bp, Artificial Sequence
  Synthetic polynucleotide
cccttagccgtacaaatcgcatctcgtggaatccattcagttcacagg

SEQ ID NO: 10941 - DNA, 48 bp, Artificial Sequence
  Synthetic polynucleotide
gcaggtaaatgcaaaacccttagccgtacaaagcgttactgacccgct

SEQ ID NO: 10942 - DNA, 48 bp, Artificial Sequence
  Synthetic polynucleotide
aaaagcagtcaaccggcgacgagtaacggcatctatgtctttctgagg

SEQ ID NO: 10943 - DNA, 48 bp, Artificial Sequence
  Synthetic polynucleotide
cgaaggggctcgagtctacagcagagctacgcgagtccccgaagaata

SEQ ID NO: 10944 - DNA, 48 bp, Artificial Sequence
  Synthetic polynucleotide
aatccgatgaccctaaaggagcagtttgggtctacggcaccgaggcct

SEQ ID NO: 10945 - DNA, 48 bp, Artificial Sequence
  Synthetic polynucleotide
ggatattctccgccggaatccgatgaccctaagagtccccgaagaata

SEQ ID NO: 10946 - DNA, 48 bp, Artificial Sequence
  Synthetic polynucleotide
cactgtgtggacgtttgagcaatagaaattgacaagtaagcagggcgt

SEQ ID NO: 10947 - DNA, 48 bp, Artificial Sequence
  Synthetic polynucleotide
tcgcatctcgtggaatccattcagttcacaggcgacgagtaacggcat

SEQ ID NO: 10948 - DNA, 48 bp, Artificial Sequence; identical to SEQ ID NO: 2834
  Synthetic polynucleotide

SEQ ID NO: 10949 - DNA, 48 bp, Artificial Sequence
  Synthetic polynucleotide
cttccgactttttataaaaagcagtcaaccggcgacgagtaacggcat

SEQ ID NO: 10950 - DNA, 48 bp, Artificial Sequence
  Synthetic polynucleotide
atcggctcaagacgtagaatgagcgacgcaccactgctgggtgggcgc

SEQ ID NO: 10951 - DNA, 48 bp, Artificial Sequence
  Synthetic polynucleotide
aggagcagtttgggtctacggcaccgaggcctgagcaatagaaattga

SEQ ID NO: 10952 - DNA, 48 bp, Artificial Sequence
  Synthetic polynucleotide
tatgagttaccctgcacactgtgtggacgtttgagcaatagaaattga

SEQ ID NO: 10953 - DNA, 48 bp, Artificial Sequence
  Synthetic polynucleotide
ggatattctccgccggcaagtaagcagggcgtgaatgagcgacgcacc

SEQ ID NO: 10954 - DNA, 48 bp, Artificial Sequence
  Synthetic polynucleotide
tgataattaacactccatcggctcaagacgtagaatgagcgacgcacc

SEQ ID NO: 10955 - DNA, 48 bp, Artificial Sequence
  Synthetic polynucleotide
tgtccaagacaacatgactacagttgaccgggatgcggagaggtaggc

SEQ ID NO: 10956 - DNA, 48 bp, Artificial Sequence
  Synthetic polynucleotide
atggttaagtataggtccttgttacgatggcaagcgtcgcttaaagtg

SEQ ID NO: 10957 - DNA, 48 bp, Artificial Sequence; identical to SEQ ID NO: 2896
  Synthetic polynucleotide

SEQ ID NO: 10958 - DNA, 48 bp, Artificial Sequence
  Synthetic polynucleotide
tctctatcgtacacatctctggctttaccaagcggcgccgattgatca

SEQ ID NO: 10959 - DNA, 48 bp, Artificial Sequence
  Synthetic polynucleotide
atggttaagtataggtggtgcaaaaagcgcaacggcgccgattgatca

SEQ ID NO: 10960 - DNA, 48 bp, Artificial Sequence
  Synthetic polynucleotide
gcaatattcggaccttatggttaagtataggtccttgttacgatggca

SEQ ID NO: 10961 - DNA, 48 bp, Artificial Sequence
  Synthetic polynucleotide
tccgggatgggtgccaccgcaacctttacgtgccaccgggtctgttcc

SEQ ID NO: 10962 - DNA, 48 bp, Artificial Sequence; identical to SEQ ID NO: 2920
  Synthetic polynucleotide

SEQ ID NO: 10963 - DNA, 48 bp, Artificial Sequence
  Synthetic polynucleotide
ccactaacgggacagttctctatcgtacacatctctggctttaccaag

SEQ ID NO: 10964 - DNA, 48 bp, Artificial Sequence
  Synthetic polynucleotide
gtccaagtaagggcaatcgtatttgatgcccgcggaacatgcacgatg

SEQ ID NO: 10965 - DNA, 48 bp, Artificial Sequence
  Synthetic polynucleotide
ggtgcaaaaagcgcaacggcgccgattgatcaccgcaacctttacgtg

SEQ ID NO: 10966 - DNA, 48 bp, Artificial Sequence; identical to SEQ ID NO: 2944
  Synthetic polynucleotide

SEQ ID NO: 10967 - DNA, 48 bp, Artificial Sequence
  Synthetic polynucleotide
tttagggaatacaagatccgggatgggtgccaccgcaacctttacgtg

SEQ ID NO: 10968 - DNA, 48 bp, Artificial Sequence
  Synthetic polynucleotide
ccgtcacgcattgtggttcgccgcgtcgttttttcagcagccttactc

SEQ ID NO: 10969 - DNA, 48 bp, Artificial Sequence
  Synthetic polynucleotide
gcaatattcggaccttccaccgggtctgttccggaacaacgggtgtca

SEQ ID NO: 10970 - DNA, 48 bp, Artificial Sequence
  Synthetic polynucleotide
agcaatatcacggacatttagggaatacaagattcagcagccttactc

SEQ ID NO: 10971 - DNA, 48 bp, Artificial Sequence
  Synthetic polynucleotide
tgtgtatgctcactttgtccaagtaagggcaatcgtatttgatgcccg

SEQ ID NO: 10972 - DNA, 48 bp, Artificial Sequence
  Synthetic polynucleotide
aagcatcgcgtccttggcatccgctcgcatggtctggcgccggcttag

SEQ ID NO: 10973 - DNA, 48 bp, Artificial Sequence
  Synthetic polynucleotide
ccactaacgggacagtcggaacatgcacgatgttcgccgcgtcgtttt

SEQ ID NO: 10974 - DNA, 48 bp, Artificial Sequence
  Synthetic polynucleotide
ccgtcacgcattgtggtgtgtatgctcacttttctggcgccggcttag

SEQ ID NO: 10975 - DNA, 48 bp, Artificial Sequence; identical to SEQ ID NO: 2992
  Synthetic polynucleotide

SEQ ID NO: 10976 - DNA, 48 bp, Artificial Sequence
  Synthetic polynucleotide
cctcatgtaacggtcgtatccgcctatctcgcacaggacgatgttctc

SEQ ID NO: 10977 - DNA, 48 bp, Artificial Sequence
  Synthetic polynucleotide
tttagggaatacaagattcagcagccttactcattttggcggaacggg

SEQ ID NO: 10978 - DNA, 48 bp, Artificial Sequence
  Synthetic polynucleotide
acctcttcaggtcttactcagtttaagattcaacaggacgatgttctc

SEQ ID NO: 10979 - DNA, 48 bp, Artificial Sequence; identical to SEQ ID NO: 3016
  Synthetic polynucleotide

SEQ ID NO: 10980 - DNA, 48 bp, Artificial Sequence
  Synthetic polynucleotide
tacgcgggcaatggaggtgggcgcaaaccgtttacaatatagttatat

SEQ ID NO: 10981 - DNA, 48 bp, Artificial Sequence
  Synthetic polynucleotide
tgtgtatgctcacttttctggcgccggcttagtatccgcctatctcgc

SEQ ID NO: 10982 - DNA, 48 bp, Artificial Sequence
  Synthetic polynucleotide
cctcatgtaacggtcgttaagatgtgtggcaatacaatatagttatat

SEQ ID NO: 10983 - DNA, 48 bp, Artificial Sequence
  Synthetic polynucleotide
agagttctaccagccacctcatgtaacggtcgtatccgcctatctcgc

SEQ ID NO: 10984 - DNA, 48 bp, Artificial Sequence
  Synthetic polynucleotide
ttcaacttttaaacagttgaaggtttgaaccaagagagtcgcagccct

SEQ ID NO: 10985 - DNA, 48 bp, Artificial Sequence
  Synthetic polynucleotide
ctcagtttaagattcaacaggacgatgttctccatctctgcctcgacg

SEQ ID NO: 10986 - DNA, 48 bp, Artificial Sequence; identical to SEQ ID NO: 3040
  Synthetic polynucleotide

SEQ ID NO: 10987 - DNA, 48 bp, Artificial Sequence
  Synthetic polynucleotide
accacacttgtcccgatacgcgggcaatggaggtgggcgcaaaccgtt

SEQ ID NO: 10988 - DNA, 48 bp, Artificial Sequence
  Synthetic polynucleotide
ttaagatgtgtggcaatacaatatagttatatttgaaggtttgaacca

SEQ ID NO: 10989 - DNA, 48 bp, Artificial Sequence
  Synthetic polynucleotide
gtagagtcgtagacgattcaacttttaaacagttgaaggtttgaacca

SEQ ID NO: 10990 - DNA, 48 bp, Artificial Sequence
  Synthetic polynucleotide
agagttctaccagccaagagagtcgcagccctttattgagacctatct

SEQ ID NO: 10991 - DNA, 48 bp, Artificial Sequence
  Synthetic polynucleotide
tgcgttcgacgcctgcttccgtggccccgcaagttcacaagctggcta

SEQ ID NO: 10992 - DNA, 48 bp, Artificial Sequence
  Synthetic polynucleotide
cagcacaaaccctcgcgggtgatcggccgttatagtacagtgggagtg

SEQ ID NO: 10993 - DNA, 48 bp, Artificial Sequence; identical to SEQ ID NO: 3100
  Synthetic polynucleotide

SEQ ID NO: 10994 - DNA, 48 bp, Artificial Sequence
  Synthetic polynucleotide
ccgcatcgctgaggggtgcgttcgacgcctgcttccgtggccccgcaa

SEQ ID NO: 10995 - DNA, 48 bp, Artificial Sequence
  Synthetic polynucleotide
gctgccgacacgaggcacacggcgtcagcgatgaggggatagcatacc

SEQ ID NO: 10996 - DNA, 48 bp, Artificial Sequence
  Synthetic polynucleotide
cagcacaaaccctcgcccgcatcgctgagggggaggggatagcatacc

SEQ ID NO: 10997 - DNA, 48 bp, Artificial Sequence; identical to SEQ ID NO: 3124
  Synthetic polynucleotide

SEQ ID NO: 10998 - DNA, 48 bp, Artificial Sequence
  Synthetic polynucleotide
ttgtgttgggtgtagtggattcatttaactacttctatcgatctcctt

SEQ ID NO: 10999 - DNA, 48 bp, Artificial Sequence
  Synthetic polynucleotide
atcacgctctacagcaccgtgatgagacttcgacacggcgtcagcgat

SEQ ID NO: 11000 - DNA, 48 bp, Artificial Sequence
  Synthetic polynucleotide
gctgccgacacgaggccgcaacaaaatgcaaaaccatgttgaaattgt

SEQ ID NO: 11001 - DNA, 48 bp, Artificial Sequence; identical to SEQ ID NO: 3148
  Synthetic polynucleotide

SEQ ID NO: 11002 - DNA, 48 bp, Artificial Sequence
  Synthetic polynucleotide
aggtacactccggggagtagtctgtagggtgataagacaagtagaaca

SEQ ID NO: 11003 - DNA, 48 bp, Artificial Sequence
  Synthetic polynucleotide
ccgcatcgctgagggggaggggatagcataccggattcatttaactac

SEQ ID NO: 11004 - DNA, 48 bp, Artificial Sequence
  Synthetic polynucleotide
ttgtgttgggtgtagtcgcatctacctagcaataagacaagtagaaca

SEQ ID NO: 11005 - DNA, 48 bp, Artificial Sequence
  Synthetic polynucleotide
cgatgttattacctaattgtgttgggtgtagtggattcatttaactac

SEQ ID NO: 11006 - DNA, 48 bp, Artificial Sequence
  Synthetic polynucleotide
cgcagcactacgctccaaatactgcccacggttaccatgaggagcagg

SEQ ID NO: 11007 - DNA, 48 bp, Artificial Sequence
  Synthetic polynucleotide
cgcaacaaaatgcaaaaccatgttgaaattgtgtagtctgtagggtga

SEQ ID NO: 11008 - DNA, 48 bp, Artificial Sequence
  Synthetic polynucleotide
aggtacactccggggagattgactaatacatttatgaatccagacacg

SEQ ID NO: 11009 - DNA, 48 bp, Artificial Sequence
  Synthetic polynucleotide
tatacccggcaagctcaggtacactccggggagtagtctgtagggtga

SEQ ID NO: 11010 - DNA, 48 bp, Artificial Sequence
  Synthetic polynucleotide
cgcgaccacattggcactataagactactccagtcaagtggtatagcc

SEQ ID NO: 11011 - DNA, 48 bp, Artificial Sequence
  Synthetic polynucleotide
cgcatctacctagcaataagacaagtagaacaaaatactgcccacggt

SEQ ID NO: 11012 - DNA, 48 bp, Artificial Sequence; identical to SEQ ID NO: 3194
  Synthetic polynucleotide

SEQ ID NO: 11013 - DNA, 48 bp, Artificial Sequence
  Synthetic polynucleotide
attaggcactccataacgcagcactacgctccaaatactgcccacggt

SEQ ID NO: 11014 - DNA, 48 bp, Artificial Sequence
  Synthetic polynucleotide
cctcgtgatatcagaggtcgtaactcggtcgcaggcgtctcaggaagt

SEQ ID NO: 11015 - DNA, 48 bp, Artificial Sequence
  Synthetic polynucleotide
gattgactaatacatttatgaatccagacacgctataagactactcca

SEQ ID NO: 11016 - DNA, 48 bp, Artificial Sequence
  Synthetic polynucleotide
cgcgaccacattggcagttttgtgctcgacaataccctccctctgcgg

SEQ ID NO: 11017 - DNA, 48 bp, Artificial Sequence
  Synthetic polynucleotide
accacctgttgaccgacgcgaccacattggcactataagactactcca

SEQ ID NO: 11018 - DNA, 48 bp, Artificial Sequence
  Synthetic polynucleotide
tagactcagcgtgaggtatgggcctcatcccctccagagctaagaaaa

SEQ ID NO: 11019 - DNA, 48 bp, Artificial Sequence
  Synthetic polynucleotide
tatacccggcaagctcgtcaagtggtatagccgtcgtaactcggtcgc

SEQ ID NO: 11020 - DNA, 48 bp, Artificial Sequence
  Synthetic polynucleotide
cctcgtgatatcagagaccacctgttgaccgatccagagctaagaaaa

SEQ ID NO: 11021 - DNA, 48 bp, Artificial Sequence; identical to SEQ ID NO: 5095
  Synthetic polynucleotide

SEQ ID NO: 11022 - DNA, 48 bp, Artificial Sequence
  Synthetic polynucleotide
tgacgcagcatgtatgtactcatcagcacctaaaacgtctagtatttc

SEQ ID NO: 11023 - DNA, 48 bp, Artificial Sequence
  Synthetic polynucleotide
gttttgtgctcgacaataccctccctctgcggtatgggcctcatcccc

SEQ ID NO: 11024 - DNA, 48 bp, Artificial Sequence
  Synthetic polynucleotide
tgttaaaacccacaggtagactcagcgtgaggtatgggcctcatcccc

SEQ ID NO: 11025 - DNA, 48 bp, Artificial Sequence
  Synthetic polynucleotide
accacctgttgaccgatccagagctaagaaaatactcatcagcaccta

SEQ ID NO: 11026 - DNA, 48 bp, Artificial Sequence
  Synthetic polynucleotide
aacttcggggcgcatttgacgcagcatgtatgtactcatcagcaccta

SEQ ID NO: 11027 - DNA, 48 bp, Artificial Sequence
  Synthetic polynucleotide
agcgaattgagccacttaacctggccatccctcgagggtttgtttcac

SEQ ID NO: 11028 - DNA, 48 bp, Artificial Sequence
  Synthetic polynucleotide
cgtgcacatcacgtggcctctccctgccgagggggcactcgtataacc

SEQ ID NO: 11029 - DNA, 48 bp, Artificial Sequence
  Synthetic polynucleotide
caccgttcaaccgtgagtatgatttccggtttgggcactcgtataacc

SEQ ID NO: 11030 - DNA, 48 bp, Artificial Sequence
  Synthetic polynucleotide
ctaccgctcccgagccagttcgtatatgctctctatcttcgagatgcg

SEQ ID NO: 11031 - DNA, 48 bp, Artificial Sequence
  Synthetic polynucleotide
gtattagcttgagactacccgagcgcggccatgttatttctatttcga

SEQ ID NO: 11032 - DNA, 48 bp, Artificial Sequence
  Synthetic polynucleotide
caggctacactgttagggtacacggcctgtttcggaacagccaaggca

SEQ ID NO: 11033 - DNA, 48 bp, Artificial Sequence
  Synthetic polynucleotide
ggggtcactactcgatcactgagtcgctcagccggaacagccaaggca

SEQ ID NO: 11034 - DNA, 48 bp, Artificial Sequence
  Synthetic polynucleotide
agattgtatcgagaaagcaccgaaaaaagcccgggctgatcccgcaac

SEQ ID NO: 11035 - DNA, 48 bp, Artificial Sequence
  Synthetic polynucleotide
ccatatcctaagcgttacaggcggacagctaagaacttgaatcatggt

SEQ ID NO: 11036 - DNA, 48 bp, Artificial Sequence
  Synthetic polynucleotide
actgtacgtatgtgatgtcgcatatatcccaatgacgatccgcagggt

SEQ ID NO: 11037 - DNA, 48 bp, Artificial Sequence
  Synthetic polynucleotide
tatgattggttccggttcagaaacttccagcttgacgatccgcagggt

SEQ ID NO: 11038 - DNA, 48 bp, Artificial Sequence
  Synthetic polynucleotide
ggcgcatattcataacacactgacacccttttggcatcacctagaaat

SEQ ID NO: 11039 - DNA, 48 bp, Artificial Sequence
  Synthetic polynucleotide
caccagaacctagctagagggaactgcgatcattagtgaggtttcctt

SEQ ID NO: 11040 - DNA, 48 bp, Artificial Sequence
  Synthetic polynucleotide
cgaccatgttccgccctggagttagatgtccgcttacatcgcccccta

SEQ ID NO: 11041 - DNA, 48 bp, Artificial Sequence
  Synthetic polynucleotide
agcttgggccattataccaggtcaagttttggcttacatcgcccccta

SEQ ID NO: 11042 - DNA, 48 bp, Artificial Sequence
  Synthetic polynucleotide
gacagggagaatatggaaagactgtgcgagatctttacgcgcttgaac

SEQ ID NO: 11043 - DNA, 48 bp, Artificial Sequence
  Synthetic polynucleotide
gcgggccgcaaccaaaagatgttctcagtcgtcgagtcgtaacctcgt

SEQ ID NO: 11044 - DNA, 48 bp, Artificial Sequence
  Synthetic polynucleotide
ggaggcggtgggtgttccaagtcagcccctcgagtttcctcagaagtg

SEQ ID NO: 11045 - DNA, 48 bp, Artificial Sequence
  Synthetic polynucleotide
attaccgtatagccagataatagtttaatttgagtttcctcagaagtg

SEQ ID NO: 11046 - DNA, 48 bp, Artificial Sequence
  Synthetic polynucleotide
ctaatatagtatagcgctcgacggaggatatgcgtttgtcgaagcgta

SEQ ID NO: 11047 - DNA, 48 bp, Artificial Sequence
  Synthetic polynucleotide
ctaatatagtatagcgcccagtgaccaaggagggaatgcaacaccggc

SEQ ID NO: 11048 - DNA, 48 bp, Artificial Sequence
  Synthetic polynucleotide
tctttctctgggtaagctaatatagtatagcgctcgacggaggatatg

SEQ ID NO: 11049 - DNA, 48 bp, Artificial Sequence
  Synthetic polynucleotide
ccgcacgtgcgctttccgtcttaaacgactttatgtggttccattacg

SEQ ID NO: 11050 - DNA, 48 bp, Artificial Sequence
  Synthetic polynucleotide
cacgcgagccaccgcatctttctctgggtaagatgtggttccattacg

SEQ ID NO: 11051 - DNA, 48 bp, Artificial Sequence
  Synthetic polynucleotide
gacagggagaatatgggatagctgctatgtagatctggtcattgaaag

SEQ ID NO: 11052 - DNA, 48 bp, Artificial Sequence
  Synthetic polynucleotide
ggtcagaagctcgacagacagggagaatatggaaagactgtgcgagat

SEQ ID NO: 11053 - DNA, 48 bp, Artificial Sequence
  Synthetic polynucleotide
gaggtagcaggtctacgtgtcaagggaagttcagctctgttcctatga

SEQ ID NO: 11054 - DNA, 48 bp, Artificial Sequence
  Synthetic polynucleotide
cccccaagtgagctttggtcagaagctcgacaagctctgttcctatga

SEQ ID NO: 11055 - DNA, 48 bp, Artificial Sequence
  Synthetic polynucleotide
ggcgcatattcataactcatccggacgcttagcgcccactctatgaac

SEQ ID NO: 11056 - DNA, 48 bp, Artificial Sequence
  Synthetic polynucleotide
cctatcttggatatcgggcgcatattcataacacactgacaccctttt

SEQ ID NO: 11057 - DNA, 48 bp, Artificial Sequence
  Synthetic polynucleotide
tggatatcaggagatctaactaagtggggcaccagcccattacccaca

SEQ ID NO: 11058 - DNA, 48 bp, Artificial Sequence
  Synthetic polynucleotide
agctgttcgctgtgaccctatcttggatatcgcagcccattacccaca

SEQ ID NO: 11059 - DNA, 48 bp, Artificial Sequence
  Synthetic polynucleotide
agattgtatcgagaaactaacgattccccgtctccaaaccaaattgtg

SEQ ID NO: 11060 - DNA, 48 bp, Artificial Sequence
  Synthetic polynucleotide
atcagttattacttcgagattgtatcgagaaagcaccgaaaaaagccc

SEQ ID NO: 11061 - DNA, 48 bp, Artificial Sequence
  Synthetic polynucleotide
tatttgacggactcatcctacaatagctttattgcccatggtgacacg

SEQ ID NO: 11062 - DNA, 48 bp, Artificial Sequence
  Synthetic polynucleotide
gtccaacaaggagaaaatcagttattacttcgtgcccatggtgacacg

SEQ ID NO: 11063 - DNA, 48 bp, Artificial Sequence
  Synthetic polynucleotide
ctaccgctcccgagccaggtggcctgataatctcccacgtacaacata

SEQ ID NO: 11064 - DNA, 48 bp, Artificial Sequence
  Synthetic polynucleotide
cttgacgagtgggaggctaccgctcccgagccagttcgtatatgctct

SEQ ID NO: 11065 - DNA, 48 bp, Artificial Sequence
  Synthetic polynucleotide
gtgggagagtccggtcgtgggtaagttatggataattagtacggccac

SEQ ID NO: 11066 - DNA, 48 bp, Artificial Sequence
  Synthetic polynucleotide
gaccatagaaagcaggcttgacgagtgggaggtaattagtacggccac

SEQ ID NO: 11067 - DNA, 48 bp, Artificial Sequence
  Synthetic polynucleotide
taacctggccatccctcgagggtttgtttcaccctctccctgccgagg

SEQ ID NO: 11068 - DNA, 48 bp, Artificial Sequence
  Synthetic polynucleotide
cgtgcacatcacgtggaatgcacaaccataccaacggcgaataaaagc

SEQ ID NO: 11069 - DNA, 48 bp, Artificial Sequence
  Synthetic polynucleotide
agtacgacatccctgacgtgcacatcacgtggcctctccctgccgagg

SEQ ID NO: 11070 - DNA, 48 bp, Artificial Sequence
  Synthetic polynucleotide
gcgccagatcaccgaacgtacgcatacgatttacggggttggggcata

SEQ ID NO: 11071 - DNA, 48 bp, Artificial Sequence
  Synthetic polynucleotide
gtatgatttccggtttgggcactcgtataaccgaggcggcatcgggtt

SEQ ID NO: 11072 - DNA, 48 bp, Artificial Sequence
  Synthetic polynucleotide
agtatagtttgctttaagtacgacatccctgaacggggttggggcata

SEQ ID NO: 11073 - DNA, 48 bp, Artificial Sequence
  Synthetic polynucleotide
acccgagcgcggccatgttatttctatttcgaggtacacggcctgttt

SEQ ID NO: 11074 - DNA, 48 bp, Artificial Sequence
  Synthetic polynucleotide
caggctacactgttagcacttgaggcaacctaggtaggttccgccgca

SEQ ID NO: 11075 - DNA, 48 bp, Artificial Sequence
  Synthetic polynucleotide
atgtagcagcgcgcctcaggctacactgttagggtacacggcctgttt

SEQ ID NO: 11076 - DNA, 48 bp, Artificial Sequence
  Synthetic polynucleotide
tgcttatcccgaacgaggaacttgatgtcatgtcaaggcccgacatcc

SEQ ID NO: 11077 - DNA, 48 bp, Artificial Sequence
  Synthetic polynucleotide
cactgagtcgctcagccggaacagccaaggcataggttaaatcagcta

SEQ ID NO: 11078 - DNA, 48 bp, Artificial Sequence
  Synthetic polynucleotide
tatggtttagaaactgatgtagcagcgcgccttcaaggcccgacatcc

SEQ ID NO: 11079 - DNA, 48 bp, Artificial Sequence
  Synthetic polynucleotide
acaggcggacagctaagaacttgaatcatggtgtcgcatatatcccaa

SEQ ID NO: 11080 - DNA, 48 bp, Artificial Sequence
  Synthetic polynucleotide
actgtacgtatgtgatcgaatcaaggagcacttcgcaacgaggacgat

SEQ ID NO: 11081 - DNA, 48 bp, Artificial Sequence
  Synthetic polynucleotide
atatcaagggttggttactgtacgtatgtgatgtcgcatatatcccaa

SEQ ID NO: 11082 - DNA, 48 bp, Artificial Sequence
  Synthetic polynucleotide
gcttctcggctgaggactcgttcgggtgctaccggcatgcggtctaaa

SEQ ID NO: 11083 - DNA, 48 bp, Artificial Sequence
  Synthetic polynucleotide
tcagaaacttccagcttgacgatccgcagggtgctatgctaggtagag

SEQ ID NO: 11084 - DNA, 48 bp, Artificial Sequence
  Synthetic polynucleotide
catatattgtccctcaatatcaagggttggttcggcatgcggtctaaa

SEQ ID NO: 11085 - DNA, 48 bp, Artificial Sequence
  Synthetic polynucleotide
gagggaactgcgatcattagtgaggtttcctttggagttagatgtccg

SEQ ID NO: 11086 - DNA, 48 bp, Artificial Sequence
  Synthetic polynucleotide
cgaccatgttccgcccctaatgaagaggatgtacttgggattaggatc

SEQ ID NO: 11087 - DNA, 48 bp, Artificial Sequence
  Synthetic polynucleotide
ctcggccccagtagaacgaccatgttccgccctggagttagatgtccg

SEQ ID NO: 11088 - DNA, 48 bp, Artificial Sequence
  Synthetic polynucleotide
cccatggacccgctcgccacatgaaccgctctagcctacgtccgtgca

SEQ ID NO: 11089 - DNA, 48 bp, Artificial Sequence
  Synthetic polynucleotide
ccaggtcaagttttggcttacatcgccccctagtttgaacctgtttac

SEQ ID NO: 11090 - DNA, 48 bp, Artificial Sequence
  Synthetic polynucleotide
aataaggagcccagcgctcggccccagtagaaagcctacgtccgtgca

SEQ ID NO: 11091 - DNA, 48 bp, Artificial Sequence
  Synthetic polynucleotide
agatgttctcagtcgtcgagtcgtaacctcgtccaagtcagcccctcg

SEQ ID NO: 11092 - DNA, 48 bp, Artificial Sequence
  Synthetic polynucleotide
ggaggcggtgggtgtttactaaaataagccacagagtatagatggccg

SEQ ID NO: 11093 - DNA, 48 bp, Artificial Sequence
  Synthetic polynucleotide
tagtttgatgactaccggaggcggtgggtgttccaagtcagcccctcg

SEQ ID NO: 11094 - DNA, 48 bp, Artificial Sequence
  Synthetic polynucleotide
ccccggaagtggaaatgccactacgatattcagattgccgtaaatggt

SEQ ID NO: 11095 - DNA, 48 bp, Artificial Sequence
  Synthetic polynucleotide
ataatagtttaatttgagtttcctcagaagtggtcgctggctaatcac

SEQ ID NO: 11096 - DNA, 48 bp, Artificial Sequence
  Synthetic polynucleotide
tttttgtcgctgtatttagtttgatgactaccgattgccgtaaatggt

SEQ ID NO: 11097 - DNA, 48 bp, Artificial Sequence
  Synthetic polynucleotide
cccagtgaccaaggagggaatgcaacaccggccgtcttaaacgacttt

SEQ ID NO: 11098 - DNA, 48 bp, Artificial Sequence
  Synthetic polynucleotide
ccgcacgtgcgctttctagtccacgctgttcaacactaatccgggtat

SEQ ID NO: 11099 - DNA, 48 bp, Artificial Sequence
  Synthetic polynucleotide
cctactctaggagaagccgcacgtgcgctttccgtcttaaacgacttt

SEQ ID NO: 11100 - DNA, 48 bp, Artificial Sequence
  Synthetic polynucleotide
ctggttttctgtgctccccgagtccagcattacacgacgacgggaatt

SEQ ID NO: 11101 - DNA, 48 bp, Artificial Sequence
  Synthetic polynucleotide
tctttctctgggtaagatgtggttccattacgttccgcgtgggtatag

SEQ ID NO: 11102 - DNA, 48 bp, Artificial Sequence
  Synthetic polynucleotide
ggcgatacgcactgcccctactctaggagaagcacgacgacgggaatt

SEQ ID NO: 11103 - DNA, 48 bp, Artificial Sequence
  Synthetic polynucleotide
gatagctgctatgtagatctggtcattgaaaggtgtcaagggaagttc

SEQ ID NO: 11104 - DNA, 48 bp, Artificial Sequence
  Synthetic polynucleotide
gaggtagcaggtctaccagaaactagtggagctgtcgtataatgggta

SEQ ID NO: 11105 - DNA, 48 bp, Artificial Sequence
  Synthetic polynucleotide
actctcgtgcgtatcggaggtagcaggtctacgtgtcaagggaagttc

SEQ ID NO: 11106 - DNA, 48 bp, Artificial Sequence
  Synthetic polynucleotide
gataatactacactaatgcggcgccctgcgaatcctcggtagggtgta

SEQ ID NO: 11107 - DNA, 48 bp, Artificial Sequence
  Synthetic polynucleotide
ggtcagaagctcgacaagctctgttcctatgatcatacgacaagaact

SEQ ID NO: 11108 - DNA, 48 bp, Artificial Sequence
  Synthetic polynucleotide
cgagatgtatgccagcactctcgtgcgtatcgtcctcggtagggtgta

SEQ ID NO: 11109 - DNA, 48 bp, Artificial Sequence
  Synthetic polynucleotide
tcatccggacgcttagcgcccactctatgaactaactaagtggggcac

SEQ ID NO: 11110 - DNA, 48 bp, Artificial Sequence
  Synthetic polynucleotide
tggatatcaggagatccgtcgtcttctcataaaaaccgttatggtttc

SEQ ID NO: 11111 - DNA, 48 bp, Artificial Sequence
  Synthetic polynucleotide
tcaagctgatgtaccgtggatatcaggagatctaactaagtggggcac

SEQ ID NO: 11112 - DNA, 48 bp, Artificial Sequence
  Synthetic polynucleotide
ctcccacaaccctaacatagaatataggtcacaacagtgagctattcg

SEQ ID NO: 11113 - DNA, 48 bp, Artificial Sequence
  Synthetic polynucleotide
cctatcttggatatcgcagcccattacccacaggtacacctcacttgc

SEQ ID NO: 11114 - DNA, 48 bp, Artificial Sequence
  Synthetic polynucleotide
ccccaagtgtcttgcgtcaagctgatgtaccgaacagtgagctattcg

SEQ ID NO: 11115 - DNA, 48 bp, Artificial Sequence
  Synthetic polynucleotide
ctaacgattccccgtctccaaaccaaattgtgcctacaatagctttat

SEQ ID NO: 11116 - DNA, 48 bp, Artificial Sequence
  Synthetic polynucleotide
tatttgacggactcattcgtacaggctacatggcagtccgatgttggg

SEQ ID NO: 11117 - DNA, 48 bp, Artificial Sequence
  Synthetic polynucleotide
tgtgggctagcacgcatatttgacggactcatcctacaatagctttat

SEQ ID NO: 11118 - DNA, 48 bp, Artificial Sequence
  Synthetic polynucleotide
gatgaacaaatggcaaagcacgtagagataattttcaacttcttgcca

SEQ ID NO: 11119 - DNA, 48 bp, Artificial Sequence
  Synthetic polynucleotide
atcagttattacttcgtgcccatggtgacacggtgcagctatccgaat

SEQ ID NO: 11120 - DNA, 48 bp, Artificial Sequence
  Synthetic polynucleotide
ctaggacctgtcaagttgtgggctagcacgcatttcaacttcttgcca

SEQ ID NO: 11121 - DNA, 48 bp, Artificial Sequence
  Synthetic polynucleotide
aggtggcctgataatctcccacgtacaacatagtgggtaagttatgga

SEQ ID NO: 11122 - DNA, 48 bp, Artificial Sequence
  Synthetic polynucleotide
gtgggagagtccggtctacgctattaaccctttaagcgcgcacccgtt

SEQ ID NO: 11123 - DNA, 48 bp, Artificial Sequence
  Synthetic polynucleotide
agaaccggttggacgggtgggagagtccggtcgtgggtaagttatgga

SEQ ID NO: 11124 - DNA, 48 bp, Artificial Sequence
  Synthetic polynucleotide
ttatattaacttacctcactcgcacttagatcgcctggccctacttca

SEQ ID NO: 11125 - DNA, 48 bp, Artificial Sequence
  Synthetic polynucleotide
cttgacgagtgggaggtaattagtacggccaccggtgagattccccag

SEQ ID NO: 11126 - DNA, 48 bp, Artificial Sequence
  Synthetic polynucleotide
ccatgaaaactctagcagaaccggttggacgggcctggccctacttca

SEQ ID NO: 11127 - DNA, 48 bp, Artificial Sequence
  Synthetic polynucleotide
aatgcacaaccataccaacggcgaataaaagccgtacgcatacgattt

SEQ ID NO: 11128 - DNA, 48 bp, Artificial Sequence
  Synthetic polynucleotide
gcgccagatcaccgaatacttgaatcgcgtcgccacaaagggtgtcag

SEQ ID NO: 11129 - DNA, 48 bp, Artificial Sequence
  Synthetic polynucleotide
cggggagggtcctcacgcgccagatcaccgaacgtacgcatacgattt

SEQ ID NO: 11130 - DNA, 48 bp, Artificial Sequence
  Synthetic polynucleotide
aatgttctttcaggctacctatatagccatttctctccgccatattgt

SEQ ID NO: 11131 - DNA, 48 bp, Artificial Sequence
  Synthetic polynucleotide
agtacgacatccctgaacggggttggggcataacgactctcatctgat

SEQ ID NO: 11132 - DNA, 48 bp, Artificial Sequence
  Synthetic polynucleotide
agcaggtcttgtaatgcggggagggtcctcacctctccgccatattgt

SEQ ID NO: 11133 - DNA, 48 bp, Artificial Sequence
  Synthetic polynucleotide
cacttgaggcaacctaggtaggttccgccgcaggaacttgatgtcatg

SEQ ID NO: 11134 - DNA, 48 bp, Artificial Sequence
  Synthetic polynucleotide
tgcttatcccgaacgaaattcatcgttaatgcgtgcatctacatggtc

SEQ ID NO: 11135 - DNA, 48 bp, Artificial Sequence
  Synthetic polynucleotide
aaagcttcggtccttctgcttatcccgaacgaggaacttgatgtcatg

SEQ ID NO: 11136 - DNA, 48 bp, Artificial Sequence
  Synthetic polynucleotide
ctagtaactcaatttttaccgagcaaagtattaattagaagtcgaatt

SEQ ID NO: 11137 - DNA, 48 bp, Artificial Sequence
  Synthetic polynucleotide
atgtagcagcgcgccttcaaggcccgacatcctgctggtgaaagatac

SEQ ID NO: 11138 - DNA, 48 bp, Artificial Sequence
  Synthetic polynucleotide
attaatacggctagaaaaagcttcggtccttcaattagaagtcgaatt

SEQ ID NO: 11139 - DNA, 48 bp, Artificial Sequence
  Synthetic polynucleotide
cgaatcaaggagcacttcgcaacgaggacgatctcgttcgggtgctac

SEQ ID NO: 11140 - DNA, 48 bp, Artificial Sequence
  Synthetic polynucleotide
gcttctcggctgaggacgtcacttgacttgattgttttcgctaggtgg

SEQ ID NO: 11141 - DNA, 48 bp, Artificial Sequence
  Synthetic polynucleotide
gccttgtcatctatacgcttctcggctgaggactcgttcgggtgctac

SEQ ID NO: 11142 - DNA, 48 bp, Artificial Sequence
  Synthetic polynucleotide
ctgaaggaagacgtcctggctcgtacccatcccgggtgtccctcaagc

SEQ ID NO: 11143 - DNA, 48 bp, Artificial Sequence
  Synthetic polynucleotide
atatcaagggttggttcggcatgcggtctaaagcgttaaactgcccag

SEQ ID NO: 11144 - DNA, 48 bp, Artificial Sequence
  Synthetic polynucleotide
gaggagcgctgaagcggccttgtcatctataccgggtgtccctcaagc

SEQ ID NO: 11145 - DNA, 48 bp, Artificial Sequence
  Synthetic polynucleotide
ctaatgaagaggatgtacttgggattaggatcccacatgaaccgctct

SEQ ID NO: 11146 - DNA, 48 bp, Artificial Sequence
  Synthetic polynucleotide
cccatggacccgctcgacccgagatgacatcgtctgatggatctcagc

SEQ ID NO: 11147 - DNA, 48 bp, Artificial Sequence
  Synthetic polynucleotide
gcctgtgatggtgaatcccatggacccgctcgccacatgaaccgctct

SEQ ID NO: 11148 - DNA, 48 bp, Artificial Sequence
  Synthetic polynucleotide
tggtcggtccccgctccaacattttatctcttactcgctagtcaactt

SEQ ID NO: 11149 - DNA, 48 bp, Artificial Sequence
  Synthetic polynucleotide
ctcggccccagtagaaagcctacgtccgtgcagtaaacgataggtttc

SEQ ID NO: 11150 - DNA, 48 bp, Artificial Sequence
  Synthetic polynucleotide
accagttccgtagttcgcctgtgatggtgaatactcgctagtcaactt

SEQ ID NO: 11151 - DNA, 48 bp, Artificial Sequence
  Synthetic polynucleotide
tactaaaataagccacagagtatagatggccggccactacgatattca

SEQ ID NO: 11152 - DNA, 48 bp, Artificial Sequence
  Synthetic polynucleotide
ccccggaagtggaaattcacagtgcacaaggggattgggtatgaaaac

SEQ ID NO: 11153 - DNA, 48 bp, Artificial Sequence
  Synthetic polynucleotide
ggagaatcttgatttaccccggaagtggaaatgccactacgatattca

SEQ ID NO: 11154 - DNA, 48 bp, Artificial Sequence
  Synthetic polynucleotide
acctaatgcgaaggtcgccagtaggccgggctccgaattatggtgtgt

SEQ ID NO: 11155 - DNA, 48 bp, Artificial Sequence
  Synthetic polynucleotide
tagtttgatgactaccgattgccgtaaatggttctggttccccactgt

SEQ ID NO: 11156 - DNA, 48 bp, Artificial Sequence
  Synthetic polynucleotide
gctctaaagctgccatggagaatcttgatttaccgaattatggtgtgt

SEQ ID NO: 11157 - DNA, 48 bp, Artificial Sequence
  Synthetic polynucleotide
tagtccacgctgttcaacactaatccgggtatcccgagtccagcatta

SEQ ID NO: 11158 - DNA, 48 bp, Artificial Sequence
  Synthetic polynucleotide
ctggttttctgtgctctctgatattaaggaatcggacggaaaactaca

SEQ ID NO: 11159 - DNA, 48 bp, Artificial Sequence
  Synthetic polynucleotide
ccgtaatcgattgcgcctggttttctgtgctccccgagtccagcatta

SEQ ID NO: 11160 - DNA, 48 bp, Artificial Sequence
  Synthetic polynucleotide
aggtcatcctacaactgcactaagcgcctccggtaatggtcgtagtgg

SEQ ID NO: 11161 - DNA, 48 bp, Artificial Sequence
  Synthetic polynucleotide
cctactctaggagaagcacgacgacgggaatttataaagcgtttggaa

SEQ ID NO: 11162 - DNA, 48 bp, Artificial Sequence
  Synthetic polynucleotide
tgccatgactaagccgccgtaatcgattgcgcgtaatggtcgtagtgg

SEQ ID NO: 11163 - DNA, 48 bp, Artificial Sequence
  Synthetic polynucleotide
cagaaactagtggagctgtcgtataatgggtatgcggcgccctgcgaa

SEQ ID NO: 11164 - DNA, 48 bp, Artificial Sequence
  Synthetic polynucleotide
gataatactacactaaaccaatcaaataacttctgtatgaatctatgt

SEQ ID NO: 11165 - DNA, 48 bp, Artificial Sequence
  Synthetic polynucleotide
ttctgctaattgacgcgataatactacactaatgcggcgccctgcgaa

SEQ ID NO: 11166 - DNA, 48 bp, Artificial Sequence
  Synthetic polynucleotide
aggatggcgtgaaccctaacagcaggtcggccccaccttattacgagt

SEQ ID NO: 11167 - DNA, 48 bp, Artificial Sequence
  Synthetic polynucleotide
actctcgtgcgtatcgtcctcggtagggtgtatacgagctagacctgt

SEQ ID NO: 11168 - DNA, 48 bp, Artificial Sequence
  Synthetic polynucleotide
cttcgtcagcaaattattctgctaattgacgcccaccttattacgagt

SEQ ID NO: 11169 - DNA, 48 bp, Artificial Sequence
  Synthetic polynucleotide
cgtcgtcttctcataaaaaccgttatggtttcatagaatataggtcac

SEQ ID NO: 11170 - DNA, 48 bp, Artificial Sequence
  Synthetic polynucleotide
ctcccacaaccctaacaggaggtgtgacggagctagagctactcgccg

SEQ ID NO: 11171 - DNA, 48 bp, Artificial Sequence
  Synthetic polynucleotide
ggactatttaatgatcctcccacaaccctaacatagaatataggtcac

SEQ ID NO: 11172 - DNA, 48 bp, Artificial Sequence
  Synthetic polynucleotide
acattactgccctaacagtgttttatgctgggtgtaccattatcaaag

SEQ ID NO: 11173 - DNA, 48 bp, Artificial Sequence
  Synthetic polynucleotide
tcaagctgatgtaccgaacagtgagctattcgcgcggaactttaaacc

SEQ ID NO: 11174 - DNA, 48 bp, Artificial Sequence
  Synthetic polynucleotide
agtaattgcatttcttggactatttaatgatctgtaccattatcaaag

SEQ ID NO: 11175 - DNA, 48 bp, Artificial Sequence
  Synthetic polynucleotide
tcgtacaggctacatggcagtccgatgttgggagcacgtagagataat

SEQ ID NO: 11176 - DNA, 48 bp, Artificial Sequence
  Synthetic polynucleotide
gatgaacaaatggcaatactggagtcgctttttaacacttggtctcga

SEQ ID NO: 11177 - DNA, 48 bp, Artificial Sequence
  Synthetic polynucleotide
accattgtgggtgaccgatgaacaaatggcaaagcacgtagagataat

SEQ ID NO: 11178 - DNA, 48 bp, Artificial Sequence
  Synthetic polynucleotide
ctgaatggtattcttcttctgaatcgcgggctatagaatgctattgag

SEQ ID NO: 11179 - DNA, 48 bp, Artificial Sequence
  Synthetic polynucleotide
tgtgggctagcacgcatttcaacttcttgccagttatacaggtccggc

SEQ ID NO: 11180 - DNA, 48 bp, Artificial Sequence
  Synthetic polynucleotide
cagtgcggcaaaagataccattgtgggtgaccatagaatgctattgag

SEQ ID NO: 11181 - DNA, 48 bp, Artificial Sequence
  Synthetic polynucleotide
tacgctattaaccctttaagcgcgcacccgttcactcgcacttagatc

SEQ ID NO: 11182 - DNA, 48 bp, Artificial Sequence
  Synthetic polynucleotide
ttatattaacttacctgggagctgagtaaatgggtagaaggaactctg

SEQ ID NO: 11183 - DNA, 48 bp, Artificial Sequence
  Synthetic polynucleotide
acttaatacgcggacattatattaacttacctcactcgcacttagatc

SEQ ID NO: 11184 - DNA, 48 bp, Artificial Sequence
  Synthetic polynucleotide
cttacttgtcaatttccttccatgtaattatagcggtaacatcacata

SEQ ID NO: 11185 - DNA, 48 bp, Artificial Sequence
  Synthetic polynucleotide
agaaccggttggacgggcctggccctacttcaacttacgtgtagtgtc

SEQ ID NO: 11186 - DNA, 48 bp, Artificial Sequence
  Synthetic polynucleotide
caggcaagcggcgaaaacttaatacgcggacagcggtaacatcacata

SEQ ID NO: 11187 - DNA, 48 bp, Artificial Sequence
  Synthetic polynucleotide
tacttgaatcgcgtcgccacaaagggtgtcagacctatatagccattt

SEQ ID NO: 11188 - DNA, 48 bp, Artificial Sequence
  Synthetic polynucleotide
aatgttctttcaggctattactggcacaggatctggtctcaaacgtcc

SEQ ID NO: 11189 - DNA, 48 bp, Artificial Sequence
  Synthetic polynucleotide
gcagggtgcgaacccgaatgttctttcaggctacctatatagccattt

SEQ ID NO: 11190 - DNA, 48 bp, Artificial Sequence
  Synthetic polynucleotide
taacaagggcctacctacacagtgtgcagggtaactcatatacgtctt

SEQ ID NO: 11191 - DNA, 48 bp, Artificial Sequence
  Synthetic polynucleotide
cggggagggtcctcacctctccgccatattgtcgaccattggtcattg

SEQ ID NO: 11192 - DNA, 48 bp, Artificial Sequence
  Synthetic polynucleotide
gagctcacccgtcgatgcagggtgcgaacccgaactcatatacgtctt

SEQ ID NO: 11193 - DNA, 48 bp, Artificial Sequence
  Synthetic polynucleotide
aattcatcgttaatgcgtgcatctacatggtctaccgagcaaagtatt

SEQ ID NO: 11194 - DNA, 48 bp, Artificial Sequence
  Synthetic polynucleotide
ctagtaactcaattttgccgatggaaaaatcactgctcctttagggtc

SEQ ID NO: 11195 - DNA, 48 bp, Artificial Sequence
  Synthetic polynucleotide
cctaggcgcaaggcgcctagtaactcaatttttaccgagcaaagtatt

SEQ ID NO: 11196 - DNA, 48 bp, Artificial Sequence
  Synthetic polynucleotide
ggttgcggtgatcaatatcggattccggcggagaatatccccggttga

SEQ ID NO: 11197 - DNA, 48 bp, Artificial Sequence
  Synthetic polynucleotide
aaagcttcggtccttcaattagaagtcgaattcgctgatccggtttac

SEQ ID NO: 11198 - DNA, 48 bp, Artificial Sequence
  Synthetic polynucleotide
cgtttattgaggttagcctaggcgcaaggcgcgaatatccccggttga

SEQ ID NO: 11199 - DNA, 48 bp, Artificial Sequence
  Synthetic polynucleotide
cgtcacttgacttgattgttttcgctaggtggtggctcgtacccatcc

SEQ ID NO: 11200 - DNA, 48 bp, Artificial Sequence
  Synthetic polynucleotide
ctgaaggaagacgtccaagagcaattatgtgaccccttcgtttaaaga

SEQ ID NO: 11201 - DNA, 48 bp, Artificial Sequence
  Synthetic polynucleotide
agggttcataggcggactgaaggaagacgtcctggctcgtacccatcc

SEQ ID NO: 11202 - DNA, 48 bp, Artificial Sequence
  Synthetic polynucleotide
gcggcgaacatcgtgccgtgggacattccacgagatgcgatttgtacg

SEQ ID NO: 11203 - DNA, 48 bp, Artificial Sequence
  Synthetic polynucleotide
gccttgtcatctataccgggtgtccctcaagcgaaaactgcacaactt

SEQ ID NO: 11204 - DNA, 48 bp, Artificial Sequence
  Synthetic polynucleotide
taggcaagcgatagtaagggttcataggcggaagatgcgatttgtacg

SEQ ID NO: 11205 - DNA, 48 bp, Artificial Sequence
  Synthetic polynucleotide
acccgagatgacatcgtctgatggatctcagccaacattttatctctt

SEQ ID NO: 11206 - DNA, 48 bp, Artificial Sequence
  Synthetic polynucleotide
tggtcggtccccgctccctagaactaagaacacccgacaaggcagcag

SEQ ID NO: 11207 - DNA, 48 bp, Artificial Sequence
  Synthetic polynucleotide
tgggagaatagcgccttggtcggtccccgctccaacattttatctctt

SEQ ID NO: 11208 - DNA, 48 bp, Artificial Sequence
  Synthetic polynucleotide
ggcggatactaagccggacccaggtaggttatgcgcgggctgactctt

SEQ ID NO: 11209 - DNA, 48 bp, Artificial Sequence
  Synthetic polynucleotide
gcctgtgatggtgaatactcgctagtcaactttgatcctgcgtacctt

SEQ ID NO: 11210 - DNA, 48 bp, Artificial Sequence
  Synthetic polynucleotide
ggtatttttatccatttgggagaatagcgcctgcgcgggctgactctt

SEQ ID NO: 11211 - DNA, 48 bp, Artificial Sequence
  Synthetic polynucleotide
tcacagtgcacaaggggattgggtatgaaaacgccagtaggccgggct

SEQ ID NO: 11212 - DNA, 48 bp, Artificial Sequence
  Synthetic polynucleotide
acctaatgcgaaggtcgcccgacggatgcgttgatgatatggtaatcc

SEQ ID NO: 11213 - DNA, 48 bp, Artificial Sequence
  Synthetic polynucleotide
gatatcgctataatagacctaatgcgaaggtcgccagtaggccgggct

SEQ ID NO: 11214 - DNA, 48 bp, Artificial Sequence
  Synthetic polynucleotide
accttcaaatataactccatattaacctgccagctgatgccctgcttc

SEQ ID NO: 11215 - DNA, 48 bp, Artificial Sequence
  Synthetic polynucleotide
ggagaatcttgatttaccgaattatggtgtgtccatatgacttgtact

SEQ ID NO: 11216 - DNA, 48 bp, Artificial Sequence
  Synthetic polynucleotide
acagtgcccgcattcagatatcgctataataggctgatgccctgcttc

SEQ ID NO: 11217 - DNA, 48 bp, Artificial Sequence
  Synthetic polynucleotide
tctgatattaaggaatcggacggaaaactacagcactaagcgcctccg

SEQ ID NO: 11218 - DNA, 48 bp, Artificial Sequence
  Synthetic polynucleotide
aggtcatcctacaacttattgaagacactcaccccgcgtatcgggaca

SEQ ID NO: 11219 - DNA, 48 bp, Artificial Sequence
  Synthetic polynucleotide
ttacacataggctgcgaggtcatcctacaactgcactaagcgcctccg

SEQ ID NO: 11220 - DNA, 48 bp, Artificial Sequence
  Synthetic polynucleotide
ttgtgaacttgcggggagtgtggtctgtttaaaagttgaatcgtctac

SEQ ID NO: 11221 - DNA, 48 bp, Artificial Sequence
  Synthetic polynucleotide
ccgtaatcgattgcgcgtaatggtcgtagtggcgtcccatattttata

SEQ ID NO: 11222 - DNA, 48 bp, Artificial Sequence
  Synthetic polynucleotide
gctgtgccgcccaccattacacataggctgcgaagttgaatcgtctac

SEQ ID NO: 11223 - DNA, 48 bp, Artificial Sequence
  Synthetic polynucleotide
accaatcaaataacttctgtatgaatctatgttaacagcaggtcggcc

SEQ ID NO: 11224 - DNA, 48 bp, Artificial Sequence
  Synthetic polynucleotide
aggatggcgtgaaccccaaagggcatgtgaagcgatgcttttgccaca

SEQ ID NO: 11225 - DNA, 48 bp, Artificial Sequence
  Synthetic polynucleotide
tttacgctaagcgggtaggatggcgtgaaccctaacagcaggtcggcc

SEQ ID NO: 11226 - DNA, 48 bp, Artificial Sequence
  Synthetic polynucleotide
atcccctcatcgctgacatcttaacgaccgttacatgaggtggctggt

SEQ ID NO: 11227 - DNA, 48 bp, Artificial Sequence
  Synthetic polynucleotide
ttctgctaattgacgcccaccttattacgagtataccctattgtcgtt

SEQ ID NO: 11228 - DNA, 48 bp, Artificial Sequence
  Synthetic polynucleotide
gtggcgctgtcaagactttacgctaagcgggtacatgaggtggctggt

SEQ ID NO: 11229 - DNA, 48 bp, Artificial Sequence
  Synthetic polynucleotide
aggaggtgtgacggagctagagctactcgccgagtgttttatgctggg

SEQ ID NO: 11230 - DNA, 48 bp, Artificial Sequence
  Synthetic polynucleotide
acattactgccctaacacgggacattgttcatacttggacaaagtgag

SEQ ID NO: 11231 - DNA, 48 bp, Artificial Sequence
  Synthetic polynucleotide
agtaacgcggcactagacattactgccctaacagtgttttatgctggg

SEQ ID NO: 11232 - DNA, 48 bp, Artificial Sequence
  Synthetic polynucleotide
ttgtcttatcaccctacatacacaccacaatgcgtgacggtgaatctt

SEQ ID NO: 11233 - DNA, 48 bp, Artificial Sequence
  Synthetic polynucleotide
ggactatttaatgatctgtaccattatcaaagatcatgagttttttgt

SEQ ID NO: 11234 - DNA, 48 bp, Artificial Sequence
  Synthetic polynucleotide
cataccgtagcgggtcagtaacgcggcactagcgtgacggtgaatctt

SEQ ID NO: 11235 - DNA, 48 bp, Artificial Sequence
  Synthetic polynucleotide
tactggagtcgctttttaacacttggtctcgattctgaatcgcgggct

SEQ ID NO: 11236 - DNA, 48 bp, Artificial Sequence
  Synthetic polynucleotide
ctgaatggtattcttcggggactcgcgtagctgatagagaactgtccc

SEQ ID NO: 11237 - DNA, 48 bp, Artificial Sequence
  Synthetic polynucleotide
actcgtcgcctgtgaactgaatggtattcttcttctgaatcgcgggct

SEQ ID NO: 11238 - DNA, 48 bp, Artificial Sequence
  Synthetic polynucleotide
cacttgactggagtaggttagtggtggcacccatcccggatcttgtat

SEQ ID NO: 11239 - DNA, 48 bp, Artificial Sequence
  Synthetic polynucleotide
accattgtgggtgaccatagaatgctattgagcgtaggagttgaccta

SEQ ID NO: 11240 - DNA, 48 bp, Artificial Sequence
  Synthetic polynucleotide
agacatagatgccgttactcgtcgcctgtgaaatcccggatcttgtat

SEQ ID NO: 11241 - DNA, 48 bp, Artificial Sequence
  Synthetic polynucleotide
gggagctgagtaaatgggtagaaggaactctgcttccatgtaattata

SEQ ID NO: 11242 - DNA, 48 bp, Artificial Sequence
  Synthetic polynucleotide
cttacttgtcaatttctattgctcaggcctcgcttggacattgcgctt

SEQ ID NO: 11243 - DNA, 48 bp, Artificial Sequence
  Synthetic polynucleotide
gctcattcacgccctgcttacttgtcaatttccttccatgtaattata

SEQ ID NO: 11244 - DNA, 48 bp, Artificial Sequence
  Synthetic polynucleotide
gctctggaggggatgatttgcaccacctatacttaaccataaggtccg

SEQ ID NO: 11245 - DNA, 48 bp, Artificial Sequence
  Synthetic polynucleotide
acttaatacgcggacagcggtaacatcacatagaccacgtcctctcct

SEQ ID NO: 11246 - DNA, 48 bp, Artificial Sequence
  Synthetic polynucleotide
ccagcagtggtgcgtcgctcattcacgccctgttaaccataaggtccg

SEQ ID NO: 11247 - DNA, 48 bp, Artificial Sequence
  Synthetic polynucleotide
attactggcacaggatctggtctcaaacgtccacacagtgtgcagggt

SEQ ID NO: 11248 - DNA, 48 bp, Artificial Sequence
  Synthetic polynucleotide
taacaagggcctacctctccgcatcccggtcacgcgagaccctcacgc

SEQ ID NO: 11249 - DNA, 48 bp, Artificial Sequence
  Synthetic polynucleotide
gcgacgcttgccatcgtaacaagggcctacctacacagtgtgcagggt

SEQ ID NO: 11250 - DNA, 48 bp, Artificial Sequence
  Synthetic polynucleotide
gcagggtgcgaacccgaactcatatacgtcttgagccgatggagtgtt

SEQ ID NO: 11251 - DNA, 48 bp, Artificial Sequence
  Synthetic polynucleotide
gaaggctgcactttaagcgacgcttgccatcgttttaacacatacatg

SEQ ID NO: 11252 - DNA, 48 bp, Artificial Sequence
  Synthetic polynucleotide
gccgatggaaaaatcactgctcctttagggtcatcggattccggcgga

SEQ ID NO: 11253 - DNA, 48 bp, Artificial Sequence
  Synthetic polynucleotide
ggttgcggtgatcaatcggcgccgcttggtaacacaaaactgccaatg

SEQ ID NO: 11254 - DNA, 48 bp, Artificial Sequence
  Synthetic polynucleotide
cccggtggcacgtaaaggttgcggtgatcaatatcggattccggcgga

SEQ ID NO: 11255 - DNA, 48 bp, Artificial Sequence
  Synthetic polynucleotide
cctaggcgcaaggcgcgaatatccccggttgactgctttttataaaaa

SEQ ID NO: 11256 - DNA, 48 bp, Artificial Sequence
  Synthetic polynucleotide
gttgttccggaacagacccggtggcacgtaaacaggtggtctctgata

SEQ ID NO: 11257 - DNA, 48 bp, Artificial Sequence
  Synthetic polynucleotide
aagagcaattatgtgaccccttcgtttaaagacgtgggacattccacg

SEQ ID NO: 11258 - DNA, 48 bp, Artificial Sequence
  Synthetic polynucleotide
gcggcgaacatcgtgcatgttccgcgggcatcagtcaatctccccgga

SEQ ID NO: 11259 - DNA, 48 bp, Artificial Sequence
  Synthetic polynucleotide
ctgctgaaaaaacgacgcggcgaacatcgtgccgtgggacattccacg

SEQ ID NO: 11260 - DNA, 48 bp, Artificial Sequence
  Synthetic polynucleotide
agggttcataggcggaagatgcgatttgtacggctaagggttttgcat

SEQ ID NO: 11261 - DNA, 48 bp, Artificial Sequence
  Synthetic polynucleotide
gccaaaatgagtaaggctgctgaaaaaacgaccgggtataggagcgta

SEQ ID NO: 11262 - DNA, 48 bp, Artificial Sequence
  Synthetic polynucleotide
cctagaactaagaacacccgacaaggcagcaggacccaggtaggttat

SEQ ID NO: 11263 - DNA, 48 bp, Artificial Sequence
  Synthetic polynucleotide
ggcggatactaagccggcgccagaccatgcgattgttgcggcctcgtg

SEQ ID NO: 11264 - DNA, 48 bp, Artificial Sequence
  Synthetic polynucleotide
cgtcctgtgcgagataggcggatactaagccggacccaggtaggttat

SEQ ID NO: 11265 - DNA, 48 bp, Artificial Sequence
  Synthetic polynucleotide
tgggagaatagcgcctgcgcgggctgactctttcacataccagctgga

SEQ ID NO: 11266 - DNA, 48 bp, Artificial Sequence
  Synthetic polynucleotide
cagagatggagaacatcgtcctgtgcgagatatagatgcgactacacc

SEQ ID NO: 11267 - DNA, 48 bp, Artificial Sequence
  Synthetic polynucleotide
gcccgacggatgcgttgatgatatggtaatccccatattaacctgcca

SEQ ID NO: 11268 - DNA, 48 bp, Artificial Sequence
  Synthetic polynucleotide
accttcaaatataactatattgtaaacggtttagcgtgatgcaggcgt

SEQ ID NO: 11269 - DNA, 48 bp, Artificial Sequence
  Synthetic polynucleotide
gactctcttggttcaaaccttcaaatataactccatattaacctgcca

SEQ ID NO: 11270 - DNA, 48 bp, Artificial Sequence
  Synthetic polynucleotide
gatatcgctataataggctgatgccctgcttcgcatgagaggcgcaga

SEQ ID NO: 11271 - DNA, 48 bp, Artificial Sequence
  Synthetic polynucleotide
ctcaataaagggctgcgactctcttggttcaacgatgcgggcgagggt

SEQ ID NO: 11272 - DNA, 48 bp, Artificial Sequence
  Synthetic polynucleotide
tattgaagacactcaccccgcgtatcgggacaagtgtggtctgtttaa

SEQ ID NO: 11273 - DNA, 48 bp, Artificial Sequence
  Synthetic polynucleotide
gatcaccctagccagcttgtgaacttgcggggagtgtggtctgtttaa

SEQ ID NO: 11274 - DNA, 48 bp, Artificial Sequence
  Synthetic polynucleotide
ttacacataggctgcgaagttgaatcgtctacgactctaccctgggaa

SEQ ID NO: 11275 - DNA, 48 bp, Artificial Sequence
  Synthetic polynucleotide
atattgtaaacggtttagcgtgatgcaggcgtcgaacgcacccctcag

SEQ ID NO: 11276 - DNA, 48 bp, Artificial Sequence
  Synthetic polynucleotide
gactctcttggttcaacgatgcgggcgagggtttgtgctgcacagcac

SEQ ID NO: 11277 - DNA, 48 bp, Artificial Sequence
  Synthetic polynucleotide
caaagggcatgtgaagcgatgcttttgccacacatcttaacgaccgtt

SEQ ID NO: 11278 - DNA, 48 bp, Artificial Sequence
  Synthetic polynucleotide
atgaatccggtatgctatcccctcatcgctgacatcttaacgaccgtt

SEQ ID NO: 11279 - DNA, 48 bp, Artificial Sequence
  Synthetic polynucleotide
tttacgctaagcgggtacatgaggtggctggtagaactcttgatgtcc

SEQ ID NO: 11280 - DNA, 48 bp, Artificial Sequence
  Synthetic polynucleotide
gcgccagaccatgcgattgttgcggcctcgtgtcggcagcttgctagg

SEQ ID NO: 11281 - DNA, 48 bp, Artificial Sequence
  Synthetic polynucleotide
cgtcctgtgcgagatatagatgcgactacacccaacacaattaggtaa

SEQ ID NO: 11282 - DNA, 48 bp, Artificial Sequence
  Synthetic polynucleotide
acgggacattgttcatacttggacaaagtgagcatacacaccacaatg

SEQ ID NO: 11283 - DNA, 48 bp, Artificial Sequence
  Synthetic polynucleotide
cagtattttgttctacttgtcttatcaccctacatacacaccacaatg

SEQ ID NO: 11284 - DNA, 48 bp, Artificial Sequence
  Synthetic polynucleotide
agtaacgcggcactagcgtgacggtgaatcttaaactgagtaagacct

SEQ ID NO: 11285 - DNA, 48 bp, Artificial Sequence
  Synthetic polynucleotide
atgttccgcgggcatcagtcaatctccccggagtgtacctgagcttgc

SEQ ID NO: 11286 - DNA, 48 bp, Artificial Sequence
  Synthetic polynucleotide
ctgctgaaaaaacgaccgggtataggagcgtagtgctgcgttatggag

SEQ ID NO: 11287 - DNA, 48 bp, Artificial Sequence
  Synthetic polynucleotide
ggggactcgcgtagctgatagagaactgtcccgttagtggtggcaccc

SEQ ID NO: 11288 - DNA, 48 bp, Artificial Sequence
  Synthetic polynucleotide
gttacgacggctataccacttgactggagtaggttagtggtggcaccc

SEQ ID NO: 11289 - DNA, 48 bp, Artificial Sequence
  Synthetic polynucleotide
actcgtcgcctgtgaaatcccggatcttgtattccctaaatgtccgtg

SEQ ID NO: 11290 - DNA, 48 bp, Artificial Sequence
  Synthetic polynucleotide
cggcgccgcttggtaacacaaaactgccaatgtggtcgcgtcggtcaa

SEQ ID NO: 11291 - DNA, 48 bp, Artificial Sequence
  Synthetic polynucleotide
cccggtggcacgtaaacaggtggtctctgatatcacgaggtgagccaa

SEQ ID NO: 11292 - DNA, 48 bp, Artificial Sequence
  Synthetic polynucleotide
tattgctcaggcctcgcttggacattgcgctttttgcaccacctatac

SEQ ID NO: 11293 - DNA, 48 bp, Artificial Sequence
  Synthetic polynucleotide
gatgagtattttcttagctctggaggggatgatttgcaccacctatac

SEQ ID NO: 11294 - DNA, 48 bp, Artificial Sequence
  Synthetic polynucleotide
gctcattcacgccctgttaaccataaggtccgaatattgcagtattcc

SEQ ID NO: 11295 - DNA, 48 bp, Artificial Sequence
  Synthetic polynucleotide
ctccgcatcccggtcacgcgagaccctcacgctgagtctacctgtggg

SEQ ID NO: 11296 - DNA, 48 bp, Artificial Sequence
  Synthetic polynucleotide
gcgacgcttgccatcgttttaacacatacatgctgcgtcaaatgcgcc

SEQ ID NO: 11297 - DNA, 47 bp, Artificial Sequence
  Synthetic polynucleotide
ccaggttaagtggctcaatcatactcacggttaactgttgtgtccta

SEQ ID NO: 11298 - DNA, 30 bp, Artificial Sequence
  Synthetic polynucleotide
tgtttacttagggatggtacgaactcaacg

SEQ ID NO: 11299 - DNA, 48 bp, Artificial Sequence
  Synthetic polynucleotide
cacgctcgggtagtctcaagaagatagagagcataaattcgctaaacc

SEQ ID NO: 11300 - DNA, 32 bp, Artificial Sequence
  Synthetic polynucleotide
ggaaaagtatccgcatctcactcagtgatcga

SEQ ID NO: 11301 - DNA, 47 bp, Artificial Sequence
  Synthetic polynucleotide
gtattcatgtcgccttttcgaacggtgacacacttgtgttcattcag

SEQ ID NO: 11302 - DNA, 30 bp, Artificial Sequence
  Synthetic polynucleotide
agtagcggaaatatggccgcttcggtgcgc

SEQ ID NO: 11303 - DNA, 48 bp, Artificial Sequence
  Synthetic polynucleotide
agcgggccgcctgtaacgcttaatcagcccgggcttttgctaatacgc

SEQ ID NO: 11304 - DNA, 32 bp, Artificial Sequence
  Synthetic polynucleotide
tgagcgatgctgttgttgcggggtttctgaac

SEQ ID NO: 11305 - DNA, 32 bp, Artificial Sequence
  Synthetic polynucleotide
cggaacccgggctaatgaagccgtgaccccag

SEQ ID NO: 11306 - DNA, 30 bp, Artificial Sequence
  Synthetic polynucleotide
agactgtctgatgcaccgggagccagccac

SEQ ID NO: 11307 - DNA, 32 bp, Artificial Sequence
  Synthetic polynucleotide
ttagctgtgtcagtgtgatcgcgagttccctc

SEQ ID NO: 11308 - DNA, 32 bp, Artificial Sequence
  Synthetic polynucleotide
tagctagggtgatgccaaaagggtggatatgg

SEQ ID NO: 11309 - DNA, 32 bp, Artificial Sequence
  Synthetic polynucleotide
agctggaacggctctgatttctagtgacctgg

SEQ ID NO: 11310 - DNA, 30 bp, Artificial Sequence
  Synthetic polynucleotide
tataatggcggagctacctgacctcaatca

SEQ ID NO: 11311 - DNA, 32 bp, Artificial Sequence
  Synthetic polynucleotide
tacgtcccacggaaggattcatcccctttaag

SEQ ID NO: 11312 - DNA, 32 bp, Artificial Sequence
  Synthetic polynucleotide
aatgatcgcacagtctttgagatgttgaacat

SEQ ID NO: 11313 - DNA, 32 bp, Artificial Sequence
  Synthetic polynucleotide
cttttggttggcgtaaagatctcgcattctgg

SEQ ID NO: 11314 - DNA, 30 bp, Artificial Sequence
  Synthetic polynucleotide
tgccaaaactgccgactcgttcaagcacta

SEQ ID NO: 11315 - DNA, 32 bp, Artificial Sequence
  Synthetic polynucleotide
ttatctggctataaaagatgtctgtcagccca

SEQ ID NO: 11316 - DNA, 32 bp, Artificial Sequence
  Synthetic polynucleotide
agcttagcataagcggctggacgaccccgccg

SEQ ID NO: 11317 - DNA, 32 bp, Artificial Sequence
  Synthetic polynucleotide
tgcgacgactgaccgtcgagccctgcgcgaca

SEQ ID NO: 11318 - DNA, 30 bp, Artificial Sequence
  Synthetic polynucleotide
aacgcatatcctcggcccgccaaattaata

SEQ ID NO: 11319 - DNA, 32 bp, Artificial Sequence
  Synthetic polynucleotide
gtcgattacgcttcgcctaaaggtccttccac

SEQ ID NO: 11320 - DNA, 32 bp, Artificial Sequence
  Synthetic polynucleotide
ggtaatcgggggtgactccggcctccttggta

SEQ ID NO: 11321 - DNA, 32 bp, Artificial Sequence
  Synthetic polynucleotide
tattagcttacccactcgcgtggcacgtctac

SEQ ID NO: 11322 - DNA, 30 bp, Artificial Sequence
  Synthetic polynucleotide
gactcgtcgaacgaggactgttctacatag

SEQ ID NO: 11323 - DNA, 32 bp, Artificial Sequence; identical to SEQ ID NO: 6866
  Synthetic polynucleotide

SEQ ID NO: 11324 - DNA, 32 bp, Artificial Sequence; identical to SEQ ID NO: 6867
  Synthetic polynucleotide

SEQ ID NO: 11325 - DNA, 32 bp, Artificial Sequence; identical to SEQ ID NO: 1918
  Synthetic polynucleotide

SEQ ID NO: 11326 - DNA, 30 bp, Artificial Sequence
  Synthetic polynucleotide
cagtagttgtgattagcttgggggtgatat

SEQ ID NO: 11327 - DNA, 32 bp, Artificial Sequence
  Synthetic polynucleotide
acctcactaaactccttctaatgtgactaagc

SEQ ID NO: 11328 - DNA, 32 bp, Artificial Sequence
  Synthetic polynucleotide
gttaactccaaaggaaaccagctatcccatat

SEQ ID NO: 11329 - DNA, 32 bp, Artificial Sequence
  Synthetic polynucleotide
tcgatgtaagcggacatctatgcgcccgatat

SEQ ID NO: 11330 - DNA, 30 bp, Artificial Sequence
  Synthetic polynucleotide
ccgttcaaactagggggcttctgaccaaag

SEQ ID NO: 11331 - DNA, 32 bp, Artificial Sequence
  Synthetic polynucleotide
ctcatgagaattgtaaacaggaacagcttaga

SEQ ID NO: 11332 - DNA, 32 bp, Artificial Sequence
  Synthetic polynucleotide
gcagtcaagttcggatacgctacctatggacg

SEQ ID NO: 11333 - DNA, 32 bp, Artificial Sequence
  Synthetic polynucleotide
gggatatgcgacaccatgatccggatgagtta

SEQ ID NO: 11334 - DNA, 30 bp, Artificial Sequence
  Synthetic polynucleotide
tgaagatcgtcattgggatatacaatctcg

SEQ ID NO: 11335 - DNA, 32 bp, Artificial Sequence
  Synthetic polynucleotide
aagtaaagcatagcaccctgcgaagatagggt

SEQ ID NO: 11336 - DNA, 32 bp, Artificial Sequence
  Synthetic polynucleotide
cacagcagtaatacctctaccttgttggacgt

SEQ ID NO: 11337 - DNA, 32 bp, Artificial Sequence
  Synthetic polynucleotide
aagcgtgaaataacgaccagaaagcacgagga

SEQ ID NO: 11338 - DNA, 30 bp, Artificial Sequence
  Synthetic polynucleotide
ttatcacgtgtacctcgaaataatcgttag

SEQ ID NO: 11339 - DNA, 32 bp, Artificial Sequence
  Synthetic polynucleotide
tttctcgactgttccgaaacaggcagcggtag

SEQ ID NO: 11340 - DNA, 32 bp, Artificial Sequence
  Synthetic polynucleotide
cctcccacttaacctatgccttggtaactgat

SEQ ID NO: 11341 - DNA, 32 bp, Artificial Sequence
  Synthetic polynucleotide
tttctcctggttccgctagctgatctatggtc

SEQ ID NO: 11342 - DNA, 30 bp, Artificial Sequence
  Synthetic polynucleotide
cttaatataaccctcggaggcaaggggaga

SEQ ID NO: 11343 - DNA, 32 bp, Artificial Sequence
  Synthetic polynucleotide
gggtgaaacaggccacctggctcggggagtgc

SEQ ID NO: 11344 - DNA, 32 bp, Artificial Sequence
  Synthetic polynucleotide
cccctcggcagccgcctcggttatactcgtca

SEQ ID NO: 11345 - DNA, 32 bp, Artificial Sequence
  Synthetic polynucleotide
agcctgctttccatagctaacccgattgtgca

SEQ ID NO: 11346 - DNA, 30 bp, Artificial Sequence
  Synthetic polynucleotide
ttccacgtgagtcgtacttaaagcaaacgt

SEQ ID NO: 11347 - DNA, 32 bp, Artificial Sequence
  Synthetic polynucleotide
gggagtgcccgagcgtctgaggtatggtttac

SEQ ID NO: 11348 - DNA, 32 bp, Artificial Sequence
  Synthetic polynucleotide
ccactatgttgtctcaagtgctaacagtacta

SEQ ID NO: 11349 - DNA, 32 bp, Artificial Sequence
  Synthetic polynucleotide
attatccataactgtgcacgtcagggattctc

SEQ ID NO: 11350 - DNA, 30 bp, Artificial Sequence
  Synthetic polynucleotide
accggtggccgttgctacatcagtttcttt

SEQ ID NO: 11351 - DNA, 32 bp, Artificial Sequence
  Synthetic polynucleotide
gcactcctggggaaactatacttacgcactgg

SEQ ID NO: 11352 - DNA, 32 bp, Artificial Sequence
  Synthetic polynucleotide
tttggagggattaggcaattgctaggttgcat

SEQ ID NO: 11353 - DNA, 32 bp, Artificial Sequence
  Synthetic polynucleotide
tgtaggcacaatttttgattcgatcacataca

SEQ ID NO: 11354 - DNA, 30 bp, Artificial Sequence
  Synthetic polynucleotide
tgggcaataaagctgtagcctgaggcgcgc

SEQ ID NO: 11355 - DNA, 32 bp, Artificial Sequence; identical to SEQ ID NO: 936
  Synthetic polynucleotide

SEQ ID NO: 11356 - DNA, 32 bp, Artificial Sequence; identical to SEQ ID NO: 392
  Synthetic polynucleotide

SEQ ID NO: 11357 - DNA, 32 bp, Artificial Sequence; identical to SEQ ID NO: 73
  Synthetic polynucleotide

SEQ ID NO: 11358 - DNA, 30 bp, Artificial Sequence
  Synthetic polynucleotide
cttagttagttcatagttcattaggggcgg

SEQ ID NO: 11359 - DNA, 32 bp, Artificial Sequence
  Synthetic polynucleotide
aaatgggctggtgccccacgtacagtaaccaa

SEQ ID NO: 11360 - DNA, 32 bp, Artificial Sequence
  Synthetic polynucleotide
ccggtgtacctgtgggtagggccgagcgctgg

SEQ ID NO: 11361 - DNA, 32 bp, Artificial Sequence
  Synthetic polynucleotide
gcttacatgtgcaagtgaaatatatgacttgg

SEQ ID NO: 11362 - DNA, 30 bp, Artificial Sequence
  Synthetic polynucleotide
tcgaccagatctgctagaaaccaccaacat

SEQ ID NO: 11363 - DNA, 32 bp, Artificial Sequence
  Synthetic polynucleotide
cctccttgacacctttcaatttttagtaaaca

SEQ ID NO: 11364 - DNA, 32 bp, Artificial Sequence
  Synthetic polynucleotide
cccaacagagctgaacttcccatggtcgttct

SEQ ID NO: 11365 - DNA, 32 bp, Artificial Sequence
  Synthetic polynucleotide
actgtcgtatgatcataggatcaaactaaata

SEQ ID NO: 11366 - DNA, 30 bp, Artificial Sequence
  Synthetic polynucleotide
cagcgtaccgccagttcttgtccttattgg

SEQ ID NO: 11367 - DNA, 32 bp, Artificial Sequence
  Synthetic polynucleotide
cgatcgtgcattccaatgtttgatggccgcgt

SEQ ID NO: 11368 - DNA, 32 bp, Artificial Sequence
  Synthetic polynucleotide
ggcttattaagacggccggtgtaaccacataa

SEQ ID NO: 11369 - DNA, 32 bp, Artificial Sequence
  Synthetic polynucleotide
agtcgtccgcctccggtagtcaacgcggaacg

SEQ ID NO: 11370 - DNA, 30 bp, Artificial Sequence
  Synthetic polynucleotide
taatggcagaaagtctatacccgacaaaaa

SEQ ID NO: 11371 - DNA, 32 bp, Artificial Sequence
  Synthetic polynucleotide
cagatttgtaccggggtgaacagcacgtgcgg

SEQ ID NO: 11372 - DNA, 32 bp, Artificial Sequence
  Synthetic polynucleotide
cttctcctgtatcgccttgtgtattatactct

SEQ ID NO: 11373 - DNA, 32 bp, Artificial Sequence
  Synthetic polynucleotide
tgcgggggggtcgagcgctccactgtagtggc

SEQ ID NO: 11374 - DNA, 30 bp, Artificial Sequence
  Synthetic polynucleotide
cggccatcgtggactagaaagcgccggcaa

SEQ ID NO: 11375 - DNA, 32 bp, Artificial Sequence
  Synthetic polynucleotide
tctgaatatcgctacctccgatacgcgaacca

SEQ ID NO: 11376 - DNA, 32 bp, Artificial Sequence
  Synthetic polynucleotide
gaaccatttaagagtaggggcagtgctcagcc

SEQ ID NO: 11377 - DNA, 32 bp, Artificial Sequence
  Synthetic polynucleotide
aaacagtgggacatctcggaaaggtgtcccaa

SEQ ID NO: 11378 - DNA, 30 bp, Artificial Sequence
  Synthetic polynucleotide
gtgcaagtaaaaaaggaattatgagatcat

SEQ ID NO: 11379 - DNA, 32 bp, Artificial Sequence
  Synthetic polynucleotide
gtgggatcctaaagtttctggtagacctcgta

SEQ ID NO: 11380 - DNA, 32 bp, Artificial Sequence
  Synthetic polynucleotide
ggctagagcggtgatatccacggtacattcgt

SEQ ID NO: 11381 - DNA, 32 bp, Artificial Sequence
  Synthetic polynucleotide
ttactgcacggaacgagagtgctggcataagc

SEQ ID NO: 11382 - DNA, 30 bp, Artificial Sequence
  Synthetic polynucleotide
aagagaaacctaacttggggactaagatcg

SEQ ID NO: 11383 - DNA, 32 bp, Artificial Sequence
  Synthetic polynucleotide
ttgcgaattttcgcgcgattcgcatgtagccg

SEQ ID NO: 11384 - DNA, 32 bp, Artificial Sequence
  Synthetic polynucleotide
aacgagatcgtcctagacgacggatctcctgc

SEQ ID NO: 11385 - DNA, 32 bp, Artificial Sequence
  Synthetic polynucleotide
atgccggtagcaccgtcaaatatgcgtgcttt

SEQ ID NO: 11386 - DNA, 30 bp, Artificial Sequence
  Synthetic polynucleotide
taacgctttagacccagcttgacgcaagac

SEQ ID NO: 11387 - DNA, 32 bp, Artificial Sequence; identical to SEQ ID NO: 6445
  Synthetic polynucleotide

SEQ ID NO: 11388 - DNA, 32 bp, Artificial Sequence; identical to SEQ ID NO: 6925
  Synthetic polynucleotide

SEQ ID NO: 11389 - DNA, 32 bp, Artificial Sequence; identical to SEQ ID NO: 6926
  Synthetic polynucleotide

SEQ ID NO: 11390 - DNA, 30 bp, Artificial Sequence
  Synthetic polynucleotide
ggccttgacatgacattctcccacccgtcc

SEQ ID NO: 11391 - DNA, 32 bp, Artificial Sequence
  Synthetic polynucleotide
aacaccagcaggatgtcgagcccacaacttga

SEQ ID NO: 11392 - DNA, 32 bp, Artificial Sequence
  Synthetic polynucleotide
cagtagtacagtatcttttttcatggcggcga

SEQ ID NO: 11393 - DNA, 32 bp, Artificial Sequence
  Synthetic polynucleotide
tgtcgccgtttgctcgcgtgcgtacggctttt

SEQ ID NO: 11394 - DNA, 30 bp, Artificial Sequence
  Synthetic polynucleotide
atatagcgtagaccggacaaccccgtaaat

SEQ ID NO: 11395 - DNA, 32 bp, Artificial Sequence
  Synthetic polynucleotide
cgtaagagtcgttatgccccccggttctgcta

SEQ ID NO: 11396 - DNA, 32 bp, Artificial Sequence
  Synthetic polynucleotide
gagtgggactggatcagatgttcaagtattcg

SEQ ID NO: 11397 - DNA, 32 bp, Artificial Sequence
  Synthetic polynucleotide
gtgacctccccgcattacaacgcgcttaccaa

SEQ ID NO: 11398 - DNA, 30 bp, Artificial Sequence
  Synthetic polynucleotide
gtaacgtatgtacgacgcgatgcgagtgaa

SEQ ID NO: 11399 - DNA, 32 bp, Artificial Sequence
  Synthetic polynucleotide
cgggtggatgaatttcgttcggggccaggcga

SEQ ID NO: 11400 - DNA, 32 bp, Artificial Sequence
  Synthetic polynucleotide
tctaagtctggcgcgtgaggacacgtaagttg

SEQ ID NO: 11401 - DNA, 32 bp, Artificial Sequence
  Synthetic polynucleotide
aagtaggaagctttttctagccatagcatcga

SEQ ID NO: 11402 - DNA, 30 bp, Artificial Sequence
  Synthetic polynucleotide
cactacgacctgcttttcgacacggactgc

SEQ ID NO: 11403 - DNA, 32 bp, Artificial Sequence
  Synthetic polynucleotide
attctggacagtaactgcattaactacgtgct

SEQ ID NO: 11404 - DNA, 32 bp, Artificial Sequence; identical to SEQ ID NO: 978
  Synthetic polynucleotide

SEQ ID NO: 11405 - DNA, 32 bp, Artificial Sequence
  Synthetic polynucleotide
attatctcgataagcagaaggacctgtataac

SEQ ID NO: 11406 - DNA, 30 bp, Artificial Sequence
  Synthetic polynucleotide
tggcaagagacaaggccgcttcagaaagga

SEQ ID NO: 11407 - DNA, 32 bp, Artificial Sequence
  Synthetic polynucleotide
tagccggaccgtattaatgccgcgccaacggt

SEQ ID NO: 11408 - DNA, 32 bp, Artificial Sequence
  Synthetic polynucleotide
ttcccggacctagtgtctatcaagtctattct

SEQ ID NO: 11409 - DNA, 47 bp, Artificial Sequence
  Synthetic polynucleotide
atgaaaccattctcgggtcgagcgggtcactgttgtgacctacgaga

SEQ ID NO: 11410 - DNA, 48 bp, Artificial Sequence
  Synthetic polynucleotide
agcgtatagatgttccgcgcgaatagctcacaggcgaactacgtatga

SEQ ID NO: 11411 - DNA, 47 bp, Artificial Sequence
  Synthetic polynucleotide
attggtttaaacgctcctcgggaattaatacgacaggtggcaaacca

SEQ ID NO: 11412 - DNA, 48 bp, Artificial Sequence
  Synthetic polynucleotide
cctccgatgtcagcgccgcatacccattcactgtgaatttccacaccg

SEQ ID NO: 11413 - DNA, 47 bp, Artificial Sequence
  Synthetic polynucleotide
tcttcttgtaggacacaacagttaaccgtgagtatgatttttttttt

SEQ ID NO: 11414 - DNA, 48 bp, Artificial Sequence
  Synthetic polynucleotide
aacacaagtgtgtcaccgttcgaaggtttagcgaatttatgctctcta

SEQ ID NO: 11415 - DNA, 47 bp, Artificial Sequence
  Synthetic polynucleotide
ttttttttgcgtattagcaaaagcccgggctgattaagcgctgaatg

SEQ ID NO: 11416 - DNA, 47 bp, Artificial Sequence
  Synthetic polynucleotide
ttttttttgagccacttaacctggatccctaagtaaacaagactacc

SEQ ID NO: 11417 - DNA, 48 bp, Artificial Sequence
  Synthetic polynucleotide
cgagcgtgatgcggatacttttccaaggcgacatgaataccatatttc

SEQ ID NO: 11418 - DNA, 47 bp, Artificial Sequence
  Synthetic polynucleotide
cgctactttacaggcggcccgctacaacagcatcgctcatttttttt

SEQ ID NO: 11419 - DNA, 47 bp, Artificial Sequence
  Synthetic polynucleotide
tcgcgatccgttgagttcgtaccctggggtcacggcttctttttttt

SEQ ID NO: 11420 - DNA, 48 bp, Artificial Sequence
  Synthetic polynucleotide
gaagcggcccaggtcactagaaattcgatcactgagtgaggagggaac

SEQ ID NO: 11421 - DNA, 47 bp, Artificial Sequence
  Synthetic polynucleotide
ttttttttgttcagaaaccccgcacttaaaggggatgaatgcgcacc

SEQ ID NO: 11422 - DNA, 47 bp, Artificial Sequence
  Synthetic polynucleotide
ttttttttattagcccgggttccgtgcatcagacagtctacactgac

SEQ ID NO: 11423 - DNA, 48 bp, Artificial Sequence
  Synthetic polynucleotide
acagctaaggcatcaccctagctacagagccgttccagctagctccgc

SEQ ID NO: 11424 - DNA, 47 bp, Artificial Sequence
  Synthetic polynucleotide
cattataccttccgtgggacgtaagactgtgcgatcatttttttttt

SEQ ID NO: 11425 - DNA, 47 bp, Artificial Sequence
  Synthetic polynucleotide
cagacatcgtggctggctcccggccagaatgcgagatcttttttttt

SEQ ID NO: 11426 - DNA, 48 bp, Artificial Sequence
  Synthetic polynucleotide
ggtcaggttgtcgcgcagggctcgccatatccaccctttttgggctga

SEQ ID NO: 11427 - DNA, 47 bp, Artificial Sequence
  Synthetic polynucleotide
ttttttttatgttcaacatctcaagtggaaggacctttagtgattga

SEQ ID NO: 11428 - DNA, 47 bp, Artificial Sequence
  Synthetic polynucleotide
ttttttttttacgccaaccaaaagtcggcagttttggcattttatag

SEQ ID NO: 11429 - DNA, 48 bp, Artificial Sequence
  Synthetic polynucleotide
ccagataaccgcttatgctaagctacggtcagtcgtcgcaccgaggat

SEQ ID NO: 11430 - DNA, 47 bp, Artificial Sequence
  Synthetic polynucleotide
atgcgttgcgaagcgtaatcgacgtcacccccgattacctttttttt

SEQ ID NO: 11431 - DNA, 47 bp, Artificial Sequence
  Synthetic polynucleotide
cccagtgatagtgcttgaacgaggtagacgtgccacgcgtttttttt

SEQ ID NO: 11432 - DNA, 48 bp, Artificial Sequence
  Synthetic polynucleotide
ttggcgggccaccgcatctttctccggcggggtcgtccaggtatagcg

SEQ ID NO: 11433 - DNA, 47 bp, Artificial Sequence
  Synthetic polynucleotide
tttttttttaccaaggaggccggagcttagtcacattagatattaat

SEQ ID NO: 11434 - DNA, 47 bp, Artificial Sequence
  Synthetic polynucleotide
ttttttttagtgggtaagctaatactcgttcgacgagtcaacctcgt

SEQ ID NO: 11435 - DNA, 48 bp, Artificial Sequence
  Synthetic polynucleotide
ccaagtcagcccctcgagtttcctcagaagtggtcgctggtaatcaca

SEQ ID NO: 11436 - DNA, 47 bp, Artificial Sequence
  Synthetic polynucleotide
actactgaggagtttagtgaggtttcctttggagttaactttttttt

SEQ ID NO: 11437 - DNA, 47 bp, Artificial Sequence
  Synthetic polynucleotide
gttcctgtctatgtagaacagtcatatcgggcgcatagatttttttt

SEQ ID NO: 11438 - DNA, 48 bp, Artificial Sequence
  Synthetic polynucleotide
ccccaagctaactcatccggatcagctcgacagacagggatctaagct

SEQ ID NO: 11439 - DNA, 47 bp, Artificial Sequence
  Synthetic polynucleotide
ttttttttatatgggatagctggtaccctatcttcgcaggatatcac

SEQ ID NO: 11440 - DNA, 47 bp, Artificial Sequence
  Synthetic polynucleotide
tttttttttgtccgcttacatcgaccctagtttgaacggttacaatt

SEQ ID NO: 11441 - DNA, 48 bp, Artificial Sequence
  Synthetic polynucleotide
ctcatgagatccgaacttgactgctggtgtcgcatatccccaatgacg

SEQ ID NO: 11442 - DNA, 47 bp, Artificial Sequence
  Synthetic polynucleotide
atcttcagtgctatgctttacttaggtattactgctgtgtttttttt

SEQ ID NO: 11443 - DNA, 47 bp, Artificial Sequence
  Synthetic polynucleotide
gcctgtttctttggtcagaagcctcctcgtgctttctggtttttttt

SEQ ID NO: 11444 - DNA, 48 bp, Artificial Sequence
  Synthetic polynucleotide
gtatatccgaccatagatcagctacgtccataggtagcgtctaccgct

SEQ ID NO: 11445 - DNA, 47 bp, Artificial Sequence
  Synthetic polynucleotide
ttttttttacgtccaacaaggtaggcactccccgagccagcgagatt

SEQ ID NO: 11446 - DNA, 47 bp, Artificial Sequence
  Synthetic polynucleotide
tttttttttcgttatttcacgcttaggtacacgtgataacggaacag

SEQ ID NO: 11447 - DNA, 48 bp, Artificial Sequence
  Synthetic polynucleotide
tcgagaaataggttaagtgggagggcggaaccaggagaaagagggtta

SEQ ID NO: 11448 - DNA, 47 bp, Artificial Sequence
  Synthetic polynucleotide
tattaaggtggcctgtttcacccggcggctgccgaggggtttttttt

SEQ ID NO: 11449 - DNA, 47 bp, Artificial Sequence
  Synthetic polynucleotide
tacctcagctaacgattatttcgtgcacaatcgggttagtttttttt

SEQ ID NO: 11450 - DNA, 48 bp, Artificial Sequence
  Synthetic polynucleotide
ttgcctccgagaatccctgacgtgatcagttaccaaggcagtaaacca

SEQ ID NO: 11451 - DNA, 47 bp, Artificial Sequence
  Synthetic polynucleotide
tttttttttgacgagtataaccgaccagtgcgtaagtatatctcccc

SEQ ID NO: 11452 - DNA, 47 bp, Artificial Sequence
  Synthetic polynucleotide
ttttttttctatggaaagcaggctacgactcacgtggaaacgctcgg

SEQ ID NO: 11453 - DNA, 48 bp, Artificial Sequence
  Synthetic polynucleotide
gcactccctgagacaacatagtggcacagttatggataatgcaacggc

SEQ ID NO: 11454 - DNA, 47 bp, Artificial Sequence
  Synthetic polynucleotide
caccggtgtttccccaggagtgcgcctaatccctccaaatttttttt

SEQ ID NO: 11455 - DNA, 47 bp, Artificial Sequence
  Synthetic polynucleotide
atatcaagacgtttgctttaagttgtatgtgatcgaatctttttttt

SEQ ID NO: 11456 - DNA, 48 bp, Artificial Sequence
  Synthetic polynucleotide
ctgatgtaggagcactaatgattatagtactgttagcactgtccctca

SEQ ID NO: 11457 - DNA, 47 bp, Artificial Sequence
  Synthetic polynucleotide
ttttttttatgcaacctagcaattttggttactgtacgtgaaagaaa

SEQ ID NO: 11458 - DNA, 47 bp, Artificial Sequence
  Synthetic polynucleotide
ttttttttaaaaattgtgcctacacagctttattgcccagtgacacg

SEQ ID NO: 11459 - DNA, 48 bp, Artificial Sequence
  Synthetic polynucleotide
gtgcagctatccgaatgacgaggtgccgatctcgcccacttatgaact

SEQ ID NO: 11460 - DNA, 47 bp, Artificial Sequence
  Synthetic polynucleotide
aactaaggggcaccagcccatttcccacaggtacaccggtttttttt

SEQ ID NO: 11461 - DNA, 47 bp, Artificial Sequence
  Synthetic polynucleotide
aaaaattggcgcgcctcaggctaccaagtcatatatttctttttttt

SEQ ID NO: 11462 - DNA, 48 bp, Artificial Sequence
  Synthetic polynucleotide
taatgaactatttagtttgatcctgccctcagtatggttttgtttact

SEQ ID NO: 11463 - DNA, 47 bp, Artificial Sequence
  Synthetic polynucleotide
ttttttttccagcgctcggccctaacgcggccatcaaacaccgcccc

SEQ ID NO: 11464 - DNA, 47 bp, Artificial Sequence
  Synthetic polynucleotide
ttttttttacttgcacatgtaagcagcagatctggtcgaaaaggtgt

SEQ ID NO: 11465 - DNA, 48 bp, Artificial Sequence
  Synthetic polynucleotide
caaggagggttcagctctgttgggatgatcatacgacagtactggcgg

SEQ ID NO: 11466 - DNA, 47 bp, Artificial Sequence
  Synthetic polynucleotide
tacgctgttggaatgcacgatcggccgtcttaataagcctttttttt

SEQ ID NO: 11467 - DNA, 47 bp, Artificial Sequence
  Synthetic polynucleotide
gctgttcaatgttggtggtttctcgttccgcgttgactatttttttt

SEQ ID NO: 11468 - DNA, 48 bp, Artificial Sequence
  Synthetic polynucleotide
ggacaagagccactacagtggagcagaacgaccatgggaaccgcacgt

SEQ ID NO: 11469 - DNA, 47 bp, Artificial Sequence
  Synthetic polynucleotide
ttttttttttatgtggttacaccgtggttcgcgtatcggaccaataa

SEQ ID NO: 11470 - DNA, 47 bp, Artificial Sequence
  Synthetic polynucleotide
ttttttttccggaggcggacgactgactttctgccattaccccggta

SEQ ID NO: 11471 - DNA, 48 bp, Artificial Sequence
  Synthetic polynucleotide
caaatctgggcgatacaggagaaggctcgacccccccgcaagtccacg

SEQ ID NO: 11472 - DNA, 47 bp, Artificial Sequence
  Synthetic polynucleotide
atggccgggtagcgatattcagatactcttaaatggttctttttttt

SEQ ID NO: 11473 - DNA, 47 bp, Artificial Sequence
  Synthetic polynucleotide
ctaccagatttttgtcgggtatattgggacacctttccgtttttttt

SEQ ID NO: 11474 - DNA, 48 bp, Artificial Sequence
  Synthetic polynucleotide
cgctttctgcttatgccagcactcagagtataatacacaatacgaggt

SEQ ID NO: 11475 - DNA, 47 bp, Artificial Sequence
  Synthetic polynucleotide
ttttttttggctgagcactgcccccggctacatgcgaatcttgccgg

SEQ ID NO: 11476 - DNA, 47 bp, Artificial Sequence
  Synthetic polynucleotide
ttttttttagatgtcccactgtttcttttttacttgcacaactttag

SEQ ID NO: 11477 - DNA, 48 bp, Artificial Sequence
  Synthetic polynucleotide
gatcccactatcaccgctctagcctcgttccgtgcagtaaagttaggt

SEQ ID NO: 11478 - DNA, 47 bp, Artificial Sequence
  Synthetic polynucleotide
ttctcttgcgcgaaaattcgcaactaggacgatctcgtttttttttt

SEQ ID NO: 11479 - DNA, 47 bp, Artificial Sequence
  Synthetic polynucleotide
ctaggaccatgatctcataattcaaagcacgcatatttgtttttttt

SEQ ID NO: 11480 - DNA, 48 bp, Artificial Sequence
  Synthetic polynucleotide
agtccccaggactcattcgtacagacgaatgtaccgtggatctgcaac

SEQ ID NO: 11481 - DNA, 47 bp, Artificial Sequence
  Synthetic polynucleotide
ttttttttgcaggagatccgtcgttcaagttgtgggctcgcgatctt

SEQ ID NO: 11482 - DNA, 47 bp, Artificial Sequence
  Synthetic polynucleotide
ttttttttacggtgctaccggcatgggtctaaagcgttactgcccag

SEQ ID NO: 11483 - DNA, 48 bp, Artificial Sequence
  Synthetic polynucleotide
tgattagcgcttagggggtaggttccgccgcaggaacttgtgtcatgt

SEQ ID NO: 11484 - DNA, 47 bp, Artificial Sequence
  Synthetic polynucleotide
caaggccacatcctgctggtgttagatactgtactactgtttttttt

SEQ ID NO: 11485 - DNA, 47 bp, Artificial Sequence
  Synthetic polynucleotide
ccgggggggtcttgcgtcaagctaaaagccgtacgcacgtttttttt

SEQ ID NO: 11486 - DNA, 48 bp, Artificial Sequence
  Synthetic polynucleotide
tgggagaattggtaagcgcgttgttaacccttactacgcttagcagaa

SEQ ID NO: 11487 - DNA, 47 bp, Artificial Sequence
  Synthetic polynucleotide
tttttttttcgccgccatgaaaaatcgcctggccccgaacggacggg

SEQ ID NO: 11488 - DNA, 47 bp, Artificial Sequence
  Synthetic polynucleotide
ttttttttcgagcaaacggcgacacggtctacgctatatcataacga

SEQ ID NO: 11489 - DNA, 48 bp, Artificial Sequence
  Synthetic polynucleotide
ctcttacgtgatccagtcccactcaatgcggggaggtcactcgtacat

SEQ ID NO: 11490 - DNA, 47 bp, Artificial Sequence
  Synthetic polynucleotide
acgttacgaaattcatccacccgacgcgccagacttagatttttttt

SEQ ID NO: 11491 - DNA, 47 bp, Artificial Sequence
  Synthetic polynucleotide
gttaatgcatttacggggttgtctcgatgctatggctagtttttttt

SEQ ID NO: 11492 - DNA, 48 bp, Artificial Sequence
  Synthetic polynucleotide
gcatcgcggttatacaggtccttccgaatacttgaacatcagcacgta

SEQ ID NO: 11493 - DNA, 47 bp, Artificial Sequence
  Synthetic polynucleotide
ttttttttcaacttacgtgtcctcaccgttggcgcggcatttcactc

SEQ ID NO: 11494 - DNA, 47 bp, Artificial Sequence
  Synthetic polynucleotide
ttttttttaaaaagcttcctacttaagcaggtcgtagtgagttactg

SEQ ID NO: 11495 - DNA, 48 bp, Artificial Sequence
  Synthetic polynucleotide
tccagaatcgtcacttatgttgggtgcttatcgagataatccttgtct

SEQ ID NO: 11496 - DNA, 47 bp, Artificial Sequence
  Synthetic polynucleotide
cttgccataatacggtccggctaacactaggtccgggaatttttttt

SEQ ID NO: 11497 - DNA, 47 bp, Artificial Sequence
  Synthetic polynucleotide
agttcgccgcagtccgtgtcgaatctcgtaggtcacaactttttttt

SEQ ID NO: 11498 - DNA, 48 bp, Artificial Sequence
  Synthetic polynucleotide
tgaagcggtggtttgccacctgtctttcaactgctgaggatcatacgt

SEQ ID NO: 11499 - DNA, 47 bp, Artificial Sequence
  Synthetic polynucleotide
ttttttttagaatagacttgatagcggtgtggaaattcactcctttc

SEQ ID NO: 11500 - DNA, 47 bp, Artificial Sequence
  Synthetic polynucleotide
ttttttttagtgacccgctcgacccgagaatggtttcattgtgagct

SEQ ID NO: 11501 - DNA, 48 bp, Artificial Sequence
  Synthetic polynucleotide
attcgcgcggaacatctatacgctgtattaattcccgaggagcgttta

SEQ ID NO: 11502 - DNA, 47 bp, Artificial Sequence
  Synthetic polynucleotide
aaccaatagtgaatgggtatgcggcgctgacatcggaggtttttttt

SEQ ID NO: 11503 - DNA, 18 bp, Artificial Sequence
  Synthetic polynucleotide
ccaggttaagtggctcaa

SEQ ID NO: 11504 - DNA, 18 bp, Artificial Sequence
  Synthetic polynucleotide
tcatactcacggttaact

SEQ ID NO: 11505 - DNA, 48 bp, Artificial Sequence
  Synthetic polynucleotide
gttgtgtcctatgtttacttagggatggtacgaactcaacgcacgctc

SEQ ID NO: 11506 - DNA, 36 bp, Artificial Sequence
  Synthetic polynucleotide
gggtagtctcaagaagatagagagcataaattcgct

SEQ ID NO: 11507 - DNA, 48 bp, Artificial Sequence
  Synthetic polynucleotide
aaaccggaaaagtatccgcatctcactcagtgatcgagtattcatgtc

SEQ ID NO: 11508 - DNA, 36 bp, Artificial Sequence
  Synthetic polynucleotide
gccttttcgaacggtgacacacttgtgttcattcag

SEQ ID NO: 11509 - DNA, 48 bp, Artificial Sequence
  Synthetic polynucleotide
agtagcggaaatatggccgcttcggtgcgcagcgggccgcctgtaacg

SEQ ID NO: 11510 - DNA, 36 bp, Artificial Sequence
  Synthetic polynucleotide
cttaatcagcccgggcttttgctaatacgctgagcg

SEQ ID NO: 11511 - DNA, 48 bp, Artificial Sequence; identical to SEQ ID NO: 96
  Synthetic polynucleotide

SEQ ID NO: 11512 - DNA, 36 bp, Artificial Sequence
  Synthetic polynucleotide
gtgaccccagagactgtctgatgcaccgggagccag

SEQ ID NO: 11513 - DNA, 48 bp, Artificial Sequence
  Synthetic polynucleotide
ccacttagctgtgtcagtgtgatcgcgagttccctctagctagggtga

SEQ ID NO: 11514 - DNA, 18 bp, Artificial Sequence
  Synthetic polynucleotide
tgccaaaagggtggatat

SEQ ID NO: 11515 - DNA, 48 bp, Artificial Sequence
  Synthetic polynucleotide
ggagctggaacggctctgatttctagtgacctggtataatggcggagc

SEQ ID NO: 11516 - DNA, 18 bp, Artificial Sequence
  Synthetic polynucleotide
tacctgacctcaatcata

SEQ ID NO: 11517 - DNA, 24 bp, Artificial Sequence
  Synthetic polynucleotide
cgtcccacggaaggattcatcccc

SEQ ID NO: 11518 - DNA, 48 bp, Artificial Sequence
  Synthetic polynucleotide
tttaagaatgatcgcacagtctttgagatgttgaacatcttttggttg

SEQ ID NO: 11519 - DNA, 60 bp, Artificial Sequence
  Synthetic polynucleotide
gcgtaaagatctcgcattctggtgccaaaactgccgactcgttcaagcactattatctgg

SEQ ID NO: 11520 - DNA, 48 bp, Artificial Sequence
  Synthetic polynucleotide
ctataaaagatgtctgtcagcccaagcttagcataagcggctggacga

SEQ ID NO: 11521 - DNA, 36 bp, Artificial Sequence
  Synthetic polynucleotide
ccccgccgtgcgacgactgaccgtcgagccctgcgc

SEQ ID NO: 11522 - DNA, 48 bp, Artificial Sequence; identical to SEQ ID NO: 1912
  Synthetic polynucleotide

SEQ ID NO: 11523 - DNA, 36 bp, Artificial Sequence
  Synthetic polynucleotide
gcctaaaggtccttccacggtaatcgggggtgactc

SEQ ID NO: 11524 - DNA, 48 bp, Artificial Sequence
  Synthetic polynucleotide
cggcctccttggtatattagcttacccactcgcgtggcacgtctacga

SEQ ID NO: 11525 - DNA, 36 bp, Artificial Sequence
  Synthetic polynucleotide
ctcgtcgaacgaggactgttctacatagtgacttgg

SEQ ID NO: 11526 - DNA, 24 bp, Artificial Sequence
  Synthetic polynucleotide
acgaggtttcactgggcgctatac

SEQ ID NO: 11527 - DNA, 60 bp, Artificial Sequence
  Synthetic polynucleotide
aggaaactcgaggggctccctgtctgtcgagcccagcgaccacttctggagaaagatgcg

SEQ ID NO: 11528 - DNA, 36 bp, Artificial Sequence
  Synthetic polynucleotide
gtggcagtagttgtgattagcttgggggtgatatac

SEQ ID NO: 11529 - DNA, 18 bp, Artificial Sequence
  Synthetic polynucleotide
ctcactaaactccttcta

SEQ ID NO: 11530 - DNA, 18 bp, Artificial Sequence
  Synthetic polynucleotide
atgtgactaagcgttaac

SEQ ID NO: 11531 - DNA, 48 bp, Artificial Sequence
  Synthetic polynucleotide
tccaaaggaaaccagctatcccatattcgatgtaagcggacatctatg

SEQ ID NO: 11532 - DNA, 36 bp, Artificial Sequence
  Synthetic polynucleotide
cgcccgatatccgttcaaactagggggcttctgacc

SEQ ID NO: 11533 - DNA, 48 bp, Artificial Sequence
  Synthetic polynucleotide
aaagctcatgagaattgtaaacaggaacagcttagagcagtcaagttc

SEQ ID NO: 11534 - DNA, 36 bp, Artificial Sequence
  Synthetic polynucleotide
ggatacgctacctatggacggggatatgcgacacca

SEQ ID NO: 11535 - DNA, 48 bp, Artificial Sequence
  Synthetic polynucleotide
tgatccggatgagttatgaagatcgtcattgggatatacaatctcgaa

SEQ ID NO: 11536 - DNA, 36 bp, Artificial Sequence
  Synthetic polynucleotide
gtaaagcatagcaccctgcgaagatagggtcacagc

SEQ ID NO: 11537 - DNA, 48 bp, Artificial Sequence; identical to SEQ ID NO: 920
  Synthetic polynucleotide

SEQ ID NO: 11538 - DNA, 36 bp, Artificial Sequence
  Synthetic polynucleotide
agcacgaggattatcacgtgtacctcgaaataatcg

SEQ ID NO: 11539 - DNA, 48 bp, Artificial Sequence
  Synthetic polynucleotide
ttagtttctcgactgttccgaaacaggcagcggtagcctcccacttaa

SEQ ID NO: 11540 - DNA, 18 bp, Artificial Sequence
  Synthetic polynucleotide
cctatgccttggtaactg

SEQ ID NO: 11541 - DNA, 48 bp, Artificial Sequence
  Synthetic polynucleotide
attttctcctggttccgctagctgatctatggtccttaatataaccct

SEQ ID NO: 11542 - DNA, 18 bp, Artificial Sequence
  Synthetic polynucleotide
cggaggcaaggggagagg

SEQ ID NO: 11543 - DNA, 24 bp, Artificial Sequence
  Synthetic polynucleotide
gtgaaacaggccacctggctcggg

SEQ ID NO: 11544 - DNA, 48 bp, Artificial Sequence; identical to SEQ ID NO: 251
  Synthetic polynucleotide

SEQ ID NO: 11545 - DNA, 60 bp, Artificial Sequence
  Synthetic polynucleotide
ccatagctaacccgattgtgcattccacgtgagtcgtacttaaagcaaacgtgggagtgc

SEQ ID NO: 11546 - DNA, 48 bp, Artificial Sequence
  Synthetic polynucleotide
ccgagcgtctgaggtatggtttacccactatgttgtctcaagtgctaa

SEQ ID NO: 11547 - DNA, 36 bp, Artificial Sequence
  Synthetic polynucleotide
cagtactaattatccataactgtgcacgtcagggat

SEQ ID NO: 11548 - DNA, 48 bp, Artificial Sequence
  Synthetic polynucleotide
tctcaccggtggccgttgctacatcagtttctttgcactcctggggaa

SEQ ID NO: 11549 - DNA, 36 bp, Artificial Sequence
  Synthetic polynucleotide
actatacttacgcactggtttggagggattaggcaa

SEQ ID NO: 11550 - DNA, 48 bp, Artificial Sequence
  Synthetic polynucleotide
ttgctaggttgcattgtaggcacaatttttgattcgatcacatacatg

SEQ ID NO: 11551 - DNA, 36 bp, Artificial Sequence
  Synthetic polynucleotide
ggcaataaagctgtagcctgaggcgcgcagctgcac

SEQ ID NO: 11552 - DNA, 24 bp, Artificial Sequence
  Synthetic polynucleotide
cgtgtcaccttgatattgagggac

SEQ ID NO: 11553 - DNA, 60 bp, Artificial Sequence
  Synthetic polynucleotide
acctcgtcattcggataaaccatactgagggcagtgggcgagatcggctaatcattagtg

SEQ ID NO: 11554 - DNA, 36 bp, Artificial Sequence
  Synthetic polynucleotide
ctcccttagttagttcatagttcattaggggcggaa

SEQ ID NO: 11555 - DNA, 18 bp, Artificial Sequence
  Synthetic polynucleotide
atgggctggtgccccacg

SEQ ID NO: 11556 - DNA, 18 bp, Artificial Sequence
  Synthetic polynucleotide
tacagtaaccaaccggtg

SEQ ID NO: 11557 - DNA, 48 bp, Artificial Sequence
  Synthetic polynucleotide
tacctgtgggtagggccgagcgctgggcttacatgtgcaagtgaaata

SEQ ID NO: 11558 - DNA, 36 bp, Artificial Sequence
  Synthetic polynucleotide
tatgacttggtcgaccagatctgctagaaaccacca

SEQ ID NO: 11559 - DNA, 48 bp, Artificial Sequence
  Synthetic polynucleotide
acatcctccttgacacctttcaatttttagtaaacacccaacagagct

SEQ ID NO: 11560 - DNA, 36 bp, Artificial Sequence
  Synthetic polynucleotide
gaacttcccatggtcgttctactgtcgtatgatcat

SEQ ID NO: 11561 - DNA, 48 bp, Artificial Sequence
  Synthetic polynucleotide
aggatcaaactaaatacagcgtaccgccagttcttgtccttattggcg

SEQ ID NO: 11562 - DNA, 36 bp, Artificial Sequence
  Synthetic polynucleotide
atcgtgcattccaatgtttgatggccgcgtggctta

SEQ ID NO: 11563 - DNA, 48 bp, Artificial Sequence; identical to SEQ ID NO: 403
  Synthetic polynucleotide

SEQ ID NO: 11564 - DNA, 36 bp, Artificial Sequence
  Synthetic polynucleotide
acgcggaacgtaatggcagaaagtctatacccgaca

SEQ ID NO: 11565 - DNA, 48 bp, Artificial Sequence
  Synthetic polynucleotide
aaaacagatttgtaccggggtgaacagcacgtgcggcttctcctgtat

SEQ ID NO: 11566 - DNA, 18 bp, Artificial Sequence
  Synthetic polynucleotide
cgccttgtgtattatact

SEQ ID NO: 11567 - DNA, 48 bp, Artificial Sequence
  Synthetic polynucleotide
cttgcgggggggtcgagcgctccactgtagtggccggccatcgtggac

SEQ ID NO: 11568 - DNA, 18 bp, Artificial Sequence
  Synthetic polynucleotide
tagaaagcgccggcaatc

SEQ ID NO: 11569 - DNA, 24 bp, Artificial Sequence
  Synthetic polynucleotide
tgaatatcgctacctccgatacgc

SEQ ID NO: 11570 - DNA, 48 bp, Artificial Sequence
  Synthetic polynucleotide
gaaccagaaccatttaagagtaggggcagtgctcagccaaacagtggg

SEQ ID NO: 11571 - DNA, 60 bp, Artificial Sequence
  Synthetic polynucleotide
acatctcggaaaggtgtcccaagtgcaagtaaaaaaggaattatgagatcatgtgggatc

SEQ ID NO: 11572 - DNA, 48 bp, Artificial Sequence
  Synthetic polynucleotide
ctaaagtttctggtagacctcgtaggctagagcggtgatatccacggt

SEQ ID NO: 11573 - DNA, 36 bp, Artificial Sequence
  Synthetic polynucleotide
acattcgtttactgcacggaacgagagtgctggcat

SEQ ID NO: 11574 - DNA, 48 bp, Artificial Sequence
  Synthetic polynucleotide
aagcaagagaaacctaacttggggactaagatcgttgcgaattttcgc

SEQ ID NO: 11575 - DNA, 36 bp, Artificial Sequence
  Synthetic polynucleotide
gcgattcgcatgtagccgaacgagatcgtcctagac

SEQ ID NO: 11576 - DNA, 48 bp, Artificial Sequence
  Synthetic polynucleotide
gacggatctcctgcatgccggtagcaccgtcaaatatgcgtgctttta

SEQ ID NO: 11577 - DNA, 36 bp, Artificial Sequence
  Synthetic polynucleotide
acgctttagacccagcttgacgcaagacgctaatca

SEQ ID NO: 11578 - DNA, 24 bp, Artificial Sequence
  Synthetic polynucleotide
ctgggcagggtcctaggttgcaga

SEQ ID NO: 11579 - DNA, 60 bp, Artificial Sequence
  Synthetic polynucleotide
aacctaccccctaagcagcgtagtaagggttacaagttcctgcggcggctgtacgaatga

SEQ ID NO: 11580 - DNA, 36 bp, Artificial Sequence
  Synthetic polynucleotide
gtccggccttgacatgacattctcccacccgtccaa

SEQ ID NO: 11581 - DNA, 42 bp, Artificial Sequence
  Synthetic polynucleotide
ttaacctgggagcgtgcgttgagttcgtaccatttttttttt

SEQ ID NO: 11582 - DNA, 56 bp, Artificial Sequence
  Synthetic polynucleotide
tttttagttaaccgtgagtatgagacatgaatactcgatcactgagtttgagccac

SEQ ID NO: 11583 - DNA, 42 bp, Artificial Sequence
  Synthetic polynucleotide
atgctctctcgttacaggcggcccgctgcgcacttttttttt

SEQ ID NO: 11584 - DNA, 56 bp, Artificial Sequence
  Synthetic polynucleotide
tttttctgaatgaacacaagtgtggcttcattagcccgggttccggtagcgaattt

SEQ ID NO: 11585 - DNA, 42 bp, Artificial Sequence
  Synthetic polynucleotide
tattagcaatcaccctagctagagggaactcgcttttttttt

SEQ ID NO: 11586 - DNA, 56 bp, Artificial Sequence
  Synthetic polynucleotide
tttttctggctcccggtgcatcagctccgccattataccaggtcactcgctcagcg

SEQ ID NO: 11587 - DNA, 42 bp, Artificial Sequence
  Synthetic polynucleotide
ttccgtgggacgttttttttttttttttttgatcacactgac

SEQ ID NO: 11588 - DNA, 42 bp, Artificial Sequence
  Synthetic polynucleotide
tggcaccagggggatgaatccacagctaagtggatatccacc

SEQ ID NO: 11589 - DNA, 42 bp, Artificial Sequence
  Synthetic polynucleotide
gcttgaacgagtcggcagtttcttttggcaagaaatcagagc

SEQ ID NO: 11590 - DNA, 42 bp, Artificial Sequence
  Synthetic polynucleotide
tcgacggtcccagataatagtcgttccagctcctatgattga

SEQ ID NO: 11591 - DNA, 42 bp, Artificial Sequence
  Synthetic polynucleotide
ttttttttttttgcgcagggcggtcaggtatttttttttttt

SEQ ID NO: 11592 - DNA, 42 bp, Artificial Sequence
  Synthetic polynucleotide
gttcaacatctcttttttttttttttttttcgaagcggccat

SEQ ID NO: 11593 - DNA, 42 bp, Artificial Sequence
  Synthetic polynucleotide
ccgattacccaaccaaaagatatttccgctactaagcccggg

SEQ ID NO: 11594 - DNA, 42 bp, Artificial Sequence
  Synthetic polynucleotide
ttatgctaagctgagtcacccctgattaagtcagaaaccccg

SEQ ID NO: 11595 - DNA, 42 bp, Artificial Sequence
  Synthetic polynucleotide
tatgtagaatcgtccagccgccaacaacagcatgacagtctc

SEQ ID NO: 11596 - DNA, 42 bp, Artificial Sequence
  Synthetic polynucleotide
ttttttttttttccaagtcactggggtcactttttttttttt

SEQ ID NO: 11597 - DNA, 42 bp, Artificial Sequence
  Synthetic polynucleotide
actattaatttgttttttttttttttttttccctaagtaaac

SEQ ID NO: 11598 - DNA, 42 bp, Artificial Sequence
  Synthetic polynucleotide
ctccagaaggaagcgtaatcgataggacacaacatcttcttg

SEQ ID NO: 11599 - DNA, 42 bp, Artificial Sequence
  Synthetic polynucleotide
cacgcgagtgggcgcatctttagactacccgagatgcggata

SEQ ID NO: 11600 - DNA, 42 bp, Artificial Sequence
  Synthetic polynucleotide
ccccaagcttcgtagacgtgccttttccggtttgtcaccgtt

SEQ ID NO: 11601 - DNA, 42 bp, Artificial Sequence
  Synthetic polynucleotide
ttttttttttttgtatatcaccgaaaaggctttttttttttt

SEQ ID NO: 11602 - DNA, 42 bp, Artificial Sequence
  Synthetic polynucleotide
cttacatcgaatttttttttttttttttttgtatagcgccca

SEQ ID NO: 11603 - DNA, 42 bp, Artificial Sequence
  Synthetic polynucleotide
tttagtgagcatagatgtccggtgaaacctcgttggtcgctg

SEQ ID NO: 11604 - DNA, 42 bp, Artificial Sequence
  Synthetic polynucleotide
tctaagctgttctagaaggagggctcgacagacagggagccc

SEQ ID NO: 11605 - DNA, 42 bp, Artificial Sequence
  Synthetic polynucleotide
tagtcacatgaacttgactgcctcgagtttcctaatcacaac

SEQ ID NO: 11606 - DNA, 42 bp, Artificial Sequence
  Synthetic polynucleotide
ttttttttttttgttaacgcttactgccactttttttttttt

SEQ ID NO: 11607 - DNA, 42 bp, Artificial Sequence
  Synthetic polynucleotide
tatcccaatgacttttttttttttttttttgcgggccgagga

SEQ ID NO: 11608 - DNA, 42 bp, Artificial Sequence
  Synthetic polynucleotide
ccccctagtttcgagattgtatatgcgtttgtcgtggaagga

SEQ ID NO: 11609 - DNA, 42 bp, Artificial Sequence
  Synthetic polynucleotide
tttcacgcttacggtcagaagcctttaggctaagctaatata

SEQ ID NO: 11610 - DNA, 42 bp, Artificial Sequence
  Synthetic polynucleotide
atatccccgttctggtcgttaccaaggaggccgcagtcctcg

SEQ ID NO: 11611 - DNA, 42 bp, Artificial Sequence
  Synthetic polynucleotide
tttttttttttttggtgtcgcttcgacgagtttttttttttt

SEQ ID NO: 11612 - DNA, 42 bp, Artificial Sequence
  Synthetic polynucleotide
ctaccgctgcctttttttttttttttttttaaagactgtgcg

SEQ ID NO: 11613 - DNA, 42 bp, Artificial Sequence
  Synthetic polynucleotide
ctatcttcgttaagtgggaggatcattcttaaaaatgcgaga

SEQ ID NO: 11614 - DNA, 42 bp, Artificial Sequence
  Synthetic polynucleotide
aggaccatagatgctgtgacctctttacgctgggctgacaga

SEQ ID NO: 11615 - DNA, 42 bp, Artificial Sequence
  Synthetic polynucleotide
cgaggtacaagggttatattacatcttttatagagtcgtcgc

SEQ ID NO: 11616 - DNA, 42 bp, Artificial Sequence
  Synthetic polynucleotide
ttttttttttttcgattatttacggcggggtttttttttttt

SEQ ID NO: 11617 - DNA, 42 bp, Artificial Sequence
  Synthetic polynucleotide
ggcctgtttcacttttttttttttttttttgtttcggaacag

SEQ ID NO: 11618 - DNA, 42 bp, Artificial Sequence
  Synthetic polynucleotide
tggaatgcacccgagccaggttcgagaaactaacagttacca

SEQ ID NO: 11619 - DNA, 42 bp, Artificial Sequence
  Synthetic polynucleotide
ttgctttaagtacgactcacgaggcataggcagctagcggaa

SEQ ID NO: 11620 - DNA, 42 bp, Artificial Sequence
  Synthetic polynucleotide
gtgcacagtgcactcccacgtccaggagaaaatcctctcccc

SEQ ID NO: 11621 - DNA, 42 bp, Artificial Sequence
  Synthetic polynucleotide
ttttttttttttatccctgacttgcctccgtttttttttttt

SEQ ID NO: 11622 - DNA, 42 bp, Artificial Sequence
  Synthetic polynucleotide
acgagtataaccttttttttttttttttttgatcttcataac

SEQ ID NO: 11623 - DNA, 42 bp, Artificial Sequence
  Synthetic polynucleotide
ccctccaaaaaagcaggcttgtcatccggatcacagggtgct

SEQ ID NO: 11624 - DNA, 42 bp, Artificial Sequence
  Synthetic polynucleotide
acaacatagtggttgcctaatatgctttacgtccaacaaggt

SEQ ID NO: 11625 - DNA, 42 bp, Artificial Sequence
  Synthetic polynucleotide
cgcgcctcattagcacttgagagaggtattactcgtgataat

SEQ ID NO: 11626 - DNA, 42 bp, Artificial Sequence
  Synthetic polynucleotide
ttttttttttttgtgcagctgcctcgtgcttttttttttttt

SEQ ID NO: 11627 - DNA, 42 bp, Artificial Sequence
  Synthetic polynucleotide
gcaaagaaactgttttttttttttttttttatgggatagctg

SEQ ID NO: 11628 - DNA, 42 bp, Artificial Sequence
  Synthetic polynucleotide
ttagccgatttccccaggagtgtttcctttggattgaacgga

SEQ ID NO: 11629 - DNA, 42 bp, Artificial Sequence
  Synthetic polynucleotide
cgaatcaaaaatcactaatgatatcgggcgctgtttacaatt

SEQ ID NO: 11630 - DNA, 42 bp, Artificial Sequence
  Synthetic polynucleotide
taatgaactcatgtatgtgatctcatgagcttttccataggt

SEQ ID NO: 11631 - DNA, 42 bp, Artificial Sequence
  Synthetic polynucleotide
ttttttttttttttccgccccagcgtatcctttttttttttt

SEQ ID NO: 11632 - DNA, 42 bp, Artificial Sequence
  Synthetic polynucleotide
acatgtaagcccttttttttttttttttttgtccctcaatat

SEQ ID NO: 11633 - DNA, 42 bp, Artificial Sequence
  Synthetic polynucleotide
ccagcccattatttcacttgccaaggtgacacgctcgcccac

SEQ ID NO: 11634 - DNA, 42 bp, Artificial Sequence
  Synthetic polynucleotide
tgtttactaaaacgtggggcatgccctcagtatggtttatcc

SEQ ID NO: 11635 - DNA, 42 bp, Artificial Sequence
  Synthetic polynucleotide
gttactgtaagctctgttggggaatgacgaggtatgaactaa

SEQ ID NO: 11636 - DNA, 42 bp, Artificial Sequence
  Synthetic polynucleotide
ttttttttttttcaccggttgctaagggagtttttttttttt

SEQ ID NO: 11637 - DNA, 42 bp, Artificial Sequence
  Synthetic polynucleotide
caagaactggcgttttttttttttttttttatgtagcaacgg

SEQ ID NO: 11638 - DNA, 42 bp, Artificial Sequence
  Synthetic polynucleotide
ctagcagatcgccaataaggaccaccggtgagaccagtgcgt

SEQ ID NO: 11639 - DNA, 42 bp, Artificial Sequence
  Synthetic polynucleotide
gcggacgacttttggtggtttaagtatagttgtgcctacaat

SEQ ID NO: 11640 - DNA, 42 bp, Artificial Sequence
  Synthetic polynucleotide
cgacagtagtgactaccggaggcaacctagcaaggctacagc

SEQ ID NO: 11641 - DNA, 42 bp, Artificial Sequence
  Synthetic polynucleotide
ttttttttttttatgatcatatttattgcctttttttttttt

SEQ ID NO: 11642 - DNA, 42 bp, Artificial Sequence
  Synthetic polynucleotide
ccgcacgtgctgttttttttttttttttttgaggcggctgcc

SEQ ID NO: 11643 - DNA, 42 bp, Artificial Sequence
  Synthetic polynucleotide
cggccatcaatacaggagaaggagggggcactccaatcgggt

SEQ ID NO: 11644 - DNA, 42 bp, Artificial Sequence
  Synthetic polynucleotide
cggccactacagtaagccacgtagctatgggtaaaccatacc

SEQ ID NO: 11645 - DNA, 42 bp, Artificial Sequence
  Synthetic polynucleotide
tagactttcgtccacgatggctcagacgctcggtatggataa

SEQ ID NO: 11646 - DNA, 42 bp, Artificial Sequence
  Synthetic polynucleotide
tttttttttttttgtcgggtattagtactgtttttttttttt

SEQ ID NO: 11647 - DNA, 42 bp, Artificial Sequence
  Synthetic polynucleotide
tagcgatattcattttttttttttttttttttcaccccggta

SEQ ID NO: 11648 - DNA, 42 bp, Artificial Sequence
  Synthetic polynucleotide
tgcacttgggcgtatcggaggcaaatctgttttagtataata

SEQ ID NO: 11649 - DNA, 42 bp, Artificial Sequence
  Synthetic polynucleotide
tctcataattccttttttactcacaaggcgtggagcgctcga

SEQ ID NO: 11650 - DNA, 42 bp, Artificial Sequence
  Synthetic polynucleotide
ctctcgttcgatcccacatgacccccccgcaaggattgccgg

SEQ ID NO: 11651 - DNA, 42 bp, Artificial Sequence
  Synthetic polynucleotide
ttttttttttttatgccagcacgctttctatttttttttttt

SEQ ID NO: 11652 - DNA, 42 bp, Artificial Sequence
  Synthetic polynucleotide
tttttttttcctactcttaaatggttctggttcgacaccttt

SEQ ID NO: 11653 - DNA, 56 bp, Artificial Sequence
  Synthetic polynucleotide
ccgagatgttacgaggtctaccagaaactttagcgtgcagtaaacgaatgtttttt

SEQ ID NO: 11654 - DNA, 42 bp, Artificial Sequence
  Synthetic polynucleotide
ctgagcactgccttttttttttttttttttgtacgctgtatt

SEQ ID NO: 11655 - DNA, 42 bp, Artificial Sequence
  Synthetic polynucleotide
gatctcgttcccactgtttggtagtttgatcctaacattgga

SEQ ID NO: 11656 - DNA, 42 bp, Artificial Sequence
  Synthetic polynucleotide
accgctctagccgtctaggacatgcacgatatgtggttacac

SEQ ID NO: 11657 - DNA, 42 bp, Artificial Sequence
  Synthetic polynucleotide
tcttgcgtcaccgtggatatccggccgtcttaatgccattac

SEQ ID NO: 11658 - DNA, 42 bp, Artificial Sequence
  Synthetic polynucleotide
tttttttttttttgattagcggttccgcgttttttttttttt

SEQ ID NO: 11659 - DNA, 42 bp, Artificial Sequence
  Synthetic polynucleotide
tttttttttccccaagttaggtttctcttgcttcggctacat

SEQ ID NO: 11660 - DNA, 56 bp, Artificial Sequence
  Synthetic polynucleotide
gcgaatcgcctaccggcatgcaggagatccgtcaagctgggtctaaagcgtttttt

SEQ ID NO: 11661 - DNA, 42 bp, Artificial Sequence
  Synthetic polynucleotide
aacgatcttagtttttttttttttttttttagcgctcggccc

SEQ ID NO: 11662 - DNA, 42 bp, Artificial Sequence
  Synthetic polynucleotide
cagccgccggcgaaaattcgctacccacaggtactggtcgac

SEQ ID NO: 11663 - DNA, 42 bp, Artificial Sequence
  Synthetic polynucleotide
tatttgacggtgtcattcgtacaagtcataattgaaaggtgt

SEQ ID NO: 11664 - DNA, 42 bp, Artificial Sequence
  Synthetic polynucleotide
tgggagaattaaaagcacgcacaaggaggatgtaacgaccat

SEQ ID NO: 11665 - DNA, 42 bp, Artificial Sequence
  Synthetic polynucleotide
ttttttttttttttggacggggggaagttctttttttttttt

SEQ ID NO: 11666 - DNA, 42 bp, Artificial Sequence
  Synthetic polynucleotide
ttttttttttctgcaacctaggaccctgcccagcaggaactt

SEQ ID NO: 11667 - DNA, 56 bp, Artificial Sequence
  Synthetic polynucleotide
gtaacccttactacgctgcttagggggtaggttgtcatgtcaaggccggacttttt

SEQ ID NO: 11668 - DNA, 33 bp, Artificial Sequence
  Synthetic polynucleotide
ttttttccaggttaagtggctcaatcatactca

SEQ ID NO: 11669 - DNA, 54 bp, Artificial Sequence
  Synthetic polynucleotide
cggttaactgttgtgtcctatgtttacttagggatggtacgaactcaacgcacg

SEQ ID NO: 11670 - DNA, 33 bp, Artificial Sequence
  Synthetic polynucleotide
ctcgggtagtctcaagaagatagagagtttttt

SEQ ID NO: 11671 - DNA, 60 bp, Artificial Sequence
  Synthetic polynucleotide
cataaattcgctaaaccggaaaagtatccgcatctcactcagtgatcgagtatttttttt

SEQ ID NO: 11672 - DNA, 60 bp, Artificial Sequence
  Synthetic polynucleotide
ttttttcatgtcgccttttcgaacggtgacacacttgtgttcattcagagtagcggaaat

SEQ ID NO: 11673 - DNA, 33 bp, Artificial Sequence
  Synthetic polynucleotide
ttttttatggccgcttcggtgcgcagcgggccg

SEQ ID NO: 11674 - DNA, 54 bp, Artificial Sequence
  Synthetic polynucleotide
cctgtaacgcttaatcagcccgggcttttgctaatacgctgagcgatgctgttg

SEQ ID NO: 11675 - DNA, 33 bp, Artificial Sequence
  Synthetic polynucleotide
ttgcggggtttctgaaccggaacccggtttttt

SEQ ID NO: 11676 - DNA, 60 bp, Artificial Sequence
  Synthetic polynucleotide
gctaatgaagccgtgaccccagagactgtctgatgcaccgggagccagccactttttttt

SEQ ID NO: 11677 - DNA, 60 bp, Artificial Sequence
  Synthetic polynucleotide
ttttttagctgtgtcagtgtgatcgcgagttccctctagctagggtgatgccaaaagggt

SEQ ID NO: 11678 - DNA, 33 bp, Artificial Sequence
  Synthetic polynucleotide
ttttttggatatggagctggaacggctctgatt

SEQ ID NO: 11679 - DNA, 54 bp, Artificial Sequence
  Synthetic polynucleotide
tctagtgacctggtataatggcggagctacctgacctcaatcatacgtcccacg

SEQ ID NO: 11680 - DNA, 33 bp, Artificial Sequence
  Synthetic polynucleotide
gaaggattcatcccctttaagaatgattttttt

SEQ ID NO: 11681 - DNA, 60 bp, Artificial Sequence
  Synthetic polynucleotide
cgcacagtctttgagatgttgaacatcttttggttggcgtaaagatctcgcatttttttt

SEQ ID NO: 11682 - DNA, 60 bp, Artificial Sequence
  Synthetic polynucleotide
ttttttctggtgccaaaactgccgactcgttcaagcactattatctggctataaaagatg

SEQ ID NO: 11683 - DNA, 60 bp, Artificial Sequence
  Synthetic polynucleotide
tttttttctgtcagcccaagcttagcataagcggctggacgaccccgccgtgcgacgact

SEQ ID NO: 11684 - DNA, 60 bp, Artificial Sequence
  Synthetic polynucleotide
gaccgtcgagccctgcgcgacaaacgcatatcctcggcccgccaaattaatagttttttt

SEQ ID NO: 11685 - DNA, 33 bp, Artificial Sequence
  Synthetic polynucleotide
cgattacgcttcgcctaaaggtccttctttttt

SEQ ID NO: 11686 - DNA, 54 bp, Artificial Sequence
  Synthetic polynucleotide
cacggtaatcgggggtgactccggcctccttggtatattagcttacccactcgc

SEQ ID NO: 11687 - DNA, 33 bp, Artificial Sequence
  Synthetic polynucleotide
ttttttgtggcacgtctacgactcgtcgaacga

SEQ ID NO: 11688 - DNA, 54 bp, Artificial Sequence
  Synthetic polynucleotide
ggactgttctacatagtgacttggacgaggtttcactgggcgctatacaggaaa

SEQ ID NO: 11689 - DNA, 60 bp, Artificial Sequence
  Synthetic polynucleotide
ctcgaggggctccctgtctgtcgagcccagcgaccacttctggagaaagatgcgtttttt

SEQ ID NO: 11690 - DNA, 33 bp, Artificial Sequence
  Synthetic polynucleotide
gtggcagtagttgtgattagcttggggtttttt

SEQ ID NO: 11691 - DNA, 54 bp, Artificial Sequence
  Synthetic polynucleotide
gtgatatacctcactaaactccttctaatgtgactaagcgttaactccaaagga

SEQ ID NO: 11692 - DNA, 33 bp, Artificial Sequence
  Synthetic polynucleotide
ttttttaaccagctatcccatattcgatgtaag

SEQ ID NO: 11693 - DNA, 54 bp, Artificial Sequence
  Synthetic polynucleotide
cggacatctatgcgcccgatatccgttcaaactagggggcttctgaccaaagct

SEQ ID NO: 11694 - DNA, 60 bp, Artificial Sequence
  Synthetic polynucleotide
catgagaattgtaaacaggaacagcttagagcagtcaagttcggatacgctacctttttt

SEQ ID NO: 11695 - DNA, 33 bp, Artificial Sequence
  Synthetic polynucleotide
tatggacggggatatgcgacaccatgatttttt

SEQ ID NO: 11696 - DNA, 54 bp, Artificial Sequence
  Synthetic polynucleotide
tccggatgagttatgaagatcgtcattgggatatacaatctcgaagtaaagcat

SEQ ID NO: 11697 - DNA, 33 bp, Artificial Sequence
  Synthetic polynucleotide
ttttttagcaccctgcgaagatagggtcacagc

SEQ ID NO: 11698 - DNA, 33 bp, Artificial Sequence
  Synthetic polynucleotide
ttttttagtaatacctctaccttgttggacgta

SEQ ID NO: 11699 - DNA, 54 bp, Artificial Sequence
  Synthetic polynucleotide
agcgtgaaataacgaccagaaagcacgaggattatcacgtgtacctcgaaataa

SEQ ID NO: 11700 - DNA, 33 bp, Artificial Sequence
  Synthetic polynucleotide
tcgttagtttctcgactgttccgaaactttttt

SEQ ID NO: 11701 - DNA, 54 bp, Artificial Sequence
  Synthetic polynucleotide
aggcagcggtagcctcccacttaacctatgccttggtaactgattttctcctgg

SEQ ID NO: 11702 - DNA, 60 bp, Artificial Sequence
  Synthetic polynucleotide
ttttttttccgctagctgatctatggtccttaatataaccctcggaggcaaggggagagg

SEQ ID NO: 11703 - DNA, 33 bp, Artificial Sequence
  Synthetic polynucleotide
ttttttgtgaaacaggccacctggctcggggag

SEQ ID NO: 11704 - DNA, 54 bp, Artificial Sequence
  Synthetic polynucleotide
tgccccctcggcagccgcctcggttatactcgtcaagcctgctttccatagcta

SEQ ID NO: 11705 - DNA, 33 bp, Artificial Sequence
  Synthetic polynucleotide
acccgattgtgcattccacgtgagtcgtttttt

SEQ ID NO: 11706 - DNA, 54 bp, Artificial Sequence
  Synthetic polynucleotide
tacttaaagcaaacgtgggagtgcccgagcgtctgaggtatggtttacccacta

SEQ ID NO: 11707 - DNA, 60 bp, Artificial Sequence
  Synthetic polynucleotide
tttttttgttgtctcaagtgctaacagtactaattatccataactgtgcacgtcagggat

SEQ ID NO: 11708 - DNA, 33 bp, Artificial Sequence
  Synthetic polynucleotide
tttttttctcaccggtggccgttgctacatcag

SEQ ID NO: 11709 - DNA, 54 bp, Artificial Sequence
  Synthetic polynucleotide
tttctttgcactcctggggaaactatacttacgcactggtttggagggattagg

SEQ ID NO: 11710 - DNA, 33 bp, Artificial Sequence
  Synthetic polynucleotide
caattgctaggttgcattgtaggcacatttttt

SEQ ID NO: 11711 - DNA, 60 bp, Artificial Sequence
  Synthetic polynucleotide
atttttgattcgatcacatacatgggcaataaagctgtagcctgaggcgcgcagtttttt

SEQ ID NO: 11712 - DNA, 60 bp, Artificial Sequence
  Synthetic polynucleotide
ttttttctgcaccgtgtcaccttgatattgagggacacctcgtcattcggataaaccata

SEQ ID NO: 11713 - DNA, 51 bp, Artificial Sequence
  Synthetic polynucleotide
ttttttctgagggcagtgggcgagatcggctaatcattagtgctcccttag

SEQ ID NO: 11714 - DNA, 18 bp, Artificial Sequence
  Synthetic polynucleotide
ttagttcatagttcatta

SEQ ID NO: 11715 - DNA, 51 bp, Artificial Sequence
  Synthetic polynucleotide
ggggcggaaatgggctggtgccccacgtacagtaaccaaccggtgtttttt

SEQ ID NO: 11716 - DNA, 51 bp, Artificial Sequence
  Synthetic polynucleotide
tacctgtgggtagggccgagcgctgggcttacatgtgcaagtgaatttttt

SEQ ID NO: 11717 - DNA, 18 bp, Artificial Sequence
  Synthetic polynucleotide
atatatgacttggtcgac

SEQ ID NO: 11718 - DNA, 51 bp, Artificial Sequence
  Synthetic polynucleotide
ttttttcagatctgctagaaaccaccaacatcctccttgacacctttcaat

SEQ ID NO: 11719 - DNA, 51 bp, Artificial Sequence
  Synthetic polynucleotide
ttttttttttagtaaacacccaacagagctgaacttcccatggtcgttcta

SEQ ID NO: 11720 - DNA, 18 bp, Artificial Sequence
  Synthetic polynucleotide
ctgtcgtatgatcatagg

SEQ ID NO: 11721 - DNA, 51 bp, Artificial Sequence
  Synthetic polynucleotide
atcaaactaaatacagcgtaccgccagttcttgtccttattggcgtttttt

SEQ ID NO: 11722 - DNA, 51 bp, Artificial Sequence
  Synthetic polynucleotide
atcgtgcattccaatgtttgatggccgcgtggcttattaagacggtttttt

SEQ ID NO: 11723 - DNA, 18 bp, Artificial Sequence
  Synthetic polynucleotide
ccggtgtaaccacataaa

SEQ ID NO: 11724 - DNA, 51 bp, Artificial Sequence
  Synthetic polynucleotide
ttttttgtcgtccgcctccggtagtcaacgcggaacgtaatggcagaaagt

SEQ ID NO: 11725 - DNA, 51 bp, Artificial Sequence
  Synthetic polynucleotide
ttttttctatacccgacaaaaacagatttgtaccggggtgaacagcacgtg

SEQ ID NO: 11726 - DNA, 18 bp, Artificial Sequence
  Synthetic polynucleotide
cggcttctcctgtatcgc

SEQ ID NO: 11727 - DNA, 51 bp, Artificial Sequence
  Synthetic polynucleotide
cttgtgtattatactcttgcgggggggtcgagcgctccactgtagtttttt

SEQ ID NO: 11728 - DNA, 51 bp, Artificial Sequence
  Synthetic polynucleotide
tggccggccatcgtggactagaaagcgccggcaatctgaatatcgtttttt

SEQ ID NO: 11729 - DNA, 18 bp, Artificial Sequence
  Synthetic polynucleotide
ctacctccgatacgcgaa

SEQ ID NO: 11730 - DNA, 51 bp, Artificial Sequence
  Synthetic polynucleotide
ttttttccagaaccatttaagagtaggggcagtgctcagccaaacagtggg

SEQ ID NO: 11731 - DNA, 60 bp, Artificial Sequence
  Synthetic polynucleotide
ttttttacatctcggaaaggtgtcccaagtgcaagtaaaaaaggaattatgagatcatgt

SEQ ID NO: 11732 - DNA, 60 bp, Artificial Sequence
  Synthetic polynucleotide
gggatcctaaagtttctggtagacctcgtaggctagagcggtgatatccacggttttttt

SEQ ID NO: 11733 - DNA, 33 bp, Artificial Sequence
  Synthetic polynucleotide
acattcgtttactgcacggaacgagagtttttt

SEQ ID NO: 11734 - DNA, 54 bp, Artificial Sequence
  Synthetic polynucleotide
tgctggcataagcaagagaaacctaacttggggactaagatcgttgcgaatttt

SEQ ID NO: 11735 - DNA, 33 bp, Artificial Sequence
  Synthetic polynucleotide
ttttttcgcgcgattcgcatgtagccgaacgag

SEQ ID NO: 11736 - DNA, 54 bp, Artificial Sequence
  Synthetic polynucleotide
atcgtcctagacgacggatctcctgcatgccggtagcaccgtcaaatatgcgtg

SEQ ID NO: 11737 - DNA, 60 bp, Artificial Sequence
  Synthetic polynucleotide
cttttaacgctttagacccagcttgacgcaagacgctaatcactgggcagggtctttttt

SEQ ID NO: 11738 - DNA, 33 bp, Artificial Sequence
  Synthetic polynucleotide
ctaggttgcagaaacctaccccctaagtttttt

SEQ ID NO: 11739 - DNA, 54 bp, Artificial Sequence
  Synthetic polynucleotide
cagcgtagtaagggttacaagttcctgcggcggctgtacgaatgagtccggcct

SEQ ID NO: 11740 - DNA, 33 bp, Artificial Sequence
  Synthetic polynucleotide
tttttttgacatgacattctcccacccgtccaa

SEQ ID NO: 11741 - DNA, 54 bp, Artificial Sequence
  Synthetic polynucleotide
caccagcaggatgtcgagcccacaacttgacagtagtacagtatcttttttcat

SEQ ID NO: 11742 - DNA, 60 bp, Artificial Sequence
  Synthetic polynucleotide
ggcggcgatgtcgccgtttgctcgcgtgcgtacggcttttatatagcgtagacctttttt

SEQ ID NO: 11743 - DNA, 33 bp, Artificial Sequence
  Synthetic polynucleotide
ggacaaccccgtaaatcgtaagagtcgtttttt

SEQ ID NO: 11744 - DNA, 54 bp, Artificial Sequence
  Synthetic polynucleotide
ttatgccccccggttctgctagagtgggactggatcagatgttcaagtattcgg

SEQ ID NO: 11745 - DNA, 33 bp, Artificial Sequence
  Synthetic polynucleotide
tttttttgacctccccgcattacaacgcgctta

SEQ ID NO: 11746 - DNA, 33 bp, Artificial Sequence
  Synthetic polynucleotide
ttttttccaagtaacgtatgtacgacgcgatgc

SEQ ID NO: 11747 - DNA, 54 bp, Artificial Sequence
  Synthetic polynucleotide
gagtgaacgggtggatgaatttcgttcggggccaggcgatctaagtctggcgcg

SEQ ID NO: 11748 - DNA, 33 bp, Artificial Sequence
  Synthetic polynucleotide
tgaggacacgtaagttgaagtaggaagtttttt

SEQ ID NO: 11749 - DNA, 54 bp, Artificial Sequence
  Synthetic polynucleotide
ctttttctagccatagcatcgacactacgacctgcttttcgacacggactgcat

SEQ ID NO: 11750 - DNA, 60 bp, Artificial Sequence
  Synthetic polynucleotide
tttttttctggacagtaactgcattaactacgtgctcccaacataagtgacgtcctcagc

SEQ ID NO: 11751 - DNA, 33 bp, Artificial Sequence
  Synthetic polynucleotide
ttttttagttgaaaattatctcgataagcagaa

SEQ ID NO: 11752 - DNA, 54 bp, Artificial Sequence
  Synthetic polynucleotide
ggacctgtataactggcaagagacaaggccgcttcagaaaggatagccggaccg

SEQ ID NO: 11753 - DNA, 33 bp, Artificial Sequence
  Synthetic polynucleotide
tattaatgccgcgccaacggtttcccgtttttt

SEQ ID NO: 11754 - DNA, 54 bp, Artificial Sequence
  Synthetic polynucleotide
gacctagtgtctatcaagtctattctatgaaaccattctcgggtcgagcgggtc

SEQ ID NO: 11755 - DNA, 60 bp, Artificial Sequence
  Synthetic polynucleotide
ttttttactgttgtgacctacgagaagcgtatagatgttccgcgcgaatagctcacaggc

SEQ ID NO: 11756 - DNA, 33 bp, Artificial Sequence
  Synthetic polynucleotide
ttttttgaactacgtatgaattggtttaaacgc

SEQ ID NO: 11757 - DNA, 54 bp, Artificial Sequence
  Synthetic polynucleotide
tcctcgggaattaatacgacaggtggcaaaccacctccgatgtcagcgccgcat

SEQ ID NO: 11758 - DNA, 33 bp, Artificial Sequence
  Synthetic polynucleotide
acccattcactgtgaatttccacaccgtttttt

SEQ ID NO: 11759 - DNA, 60 bp, Artificial Sequence
  Synthetic polynucleotide
aggattcgcaggtccatgggattcaccaagctcgtatacaccctgattctccattttttt

SEQ ID NO: 11760 - DNA, 60 bp, Artificial Sequence
  Synthetic polynucleotide
ttttttggcagcgcttcggtacaggtctgaactggtagatcaccattagtgtacccagca

SEQ ID NO: 11761 - DNA, 60 bp, Artificial Sequence
  Synthetic polynucleotide
ttttttgttcggctcccttgtggactcgggatacccggtcgtcgtgtaatgctgttccgg

SEQ ID NO: 11762 - DNA, 60 bp, Artificial Sequence
  Synthetic polynucleotide
ggtaaatcaagctttataaattcccgacgctctgttccaaactttagagcccggtttttt

SEQ ID NO: 11763 - DNA, 51 bp, Artificial Sequence
  Synthetic polynucleotide
ccgtaatctcggattccttaaaaaccaggcgcaatctcatggcattttttt

SEQ ID NO: 11764 - DNA, 18 bp, Artificial Sequence
  Synthetic polynucleotide
aaacgaaacccaatcata

SEQ ID NO: 11765 - DNA, 51 bp, Artificial Sequence
  Synthetic polynucleotide
ttttttcgagcgtggagggaagttattctactggcgttttcatatatcaga

SEQ ID NO: 11766 - DNA, 51 bp, Artificial Sequence
  Synthetic polynucleotide
ttttttgagcacagtaattcggagcccggcgtattatcgcgtcaattcata

SEQ ID NO: 11767 - DNA, 18 bp, Artificial Sequence
  Synthetic polynucleotide
tggacacaccagattacg

SEQ ID NO: 11768 - DNA, 51 bp, Artificial Sequence
  Synthetic polynucleotide
gcggcttaggggaattgagtacaagtgacgaagaataccgtccattttttt

SEQ ID NO: 11769 - DNA, 51 bp, Artificial Sequence
  Synthetic polynucleotide
cagatggagctgtcaggcttctccgtcaaaatgttggctgagatttttttt

SEQ ID NO: 11770 - DNA, 18 bp, Artificial Sequence
  Synthetic polynucleotide
gattggtttagtgtatag

SEQ ID NO: 11771 - DNA, 51 bp, Artificial Sequence
  Synthetic polynucleotide
ttttttcgagtaagagatatgtgggaggatcattacaggatcaaagttgac

SEQ ID NO: 11772 - DNA, 51 bp, Artificial Sequence
  Synthetic polynucleotide
tttttttagcagaataatttgcatccgaataaggtacgcaattactatttg

SEQ ID NO: 11773 - DNA, 18 bp, Artificial Sequence
  Synthetic polynucleotide
taccgaaaacaagggcat

SEQ ID NO: 11774 - DNA, 51 bp, Artificial Sequence
  Synthetic polynucleotide
acagtaacgaaaagcgaacgagccaccacctagcacctcctgttatttttt

SEQ ID NO: 11775 - DNA, 42 bp, Artificial Sequence
  Synthetic polynucleotide
gggtgacacccgggatgggttgttcatcggtcaccctttttt

SEQ ID NO: 11776 - DNA, 27 bp, Artificial Sequence
  Synthetic polynucleotide
cagttttcgcttgaggaatagtccaag

SEQ ID NO: 11777 - DNA, 51 bp, Artificial Sequence
  Synthetic polynucleotide
ttttttaaatgcatgataaaagttgtgccgcactggaatctgaagatgcac

SEQ ID NO: 11778 - DNA, 54 bp, Artificial Sequence
  Synthetic polynucleotide
ttgagccacttaacctggtcatggtgtcgcatatccccgtccataatgctttac

SEQ ID NO: 11779 - DNA, 45 bp, Artificial Sequence
  Synthetic polynucleotide
gtaaacataggacacaacagttaaccgtgagtatgagagatgcgg

SEQ ID NO: 11780 - DNA, 54 bp, Artificial Sequence
  Synthetic polynucleotide
agttcgtaccatccctaaaatgacgatcttcataactcatccggagctgtgacc

SEQ ID NO: 11781 - DNA, 45 bp, Artificial Sequence
  Synthetic polynucleotide
ctctctatcttcttgagactacccgagcgtgcgttggaacacaag

SEQ ID NO: 11782 - DNA, 18 bp, Artificial Sequence
  Synthetic polynucleotide
aatactcgatcactgagt

SEQ ID NO: 11783 - DNA, 27 bp, Artificial Sequence
  Synthetic polynucleotide
gcgcaccgaagcggccatccccaagct

SEQ ID NO: 11784 - DNA, 27 bp, Artificial Sequence
  Synthetic polynucleotide
cgttacaggcggcccgctgcatcagac

SEQ ID NO: 11785 - DNA, 54 bp, Artificial Sequence
  Synthetic polynucleotide
aagcccgggctgattaagcggtttagcgaatttatgatttccgctactctgaat

SEQ ID NO: 11786 - DNA, 27 bp, Artificial Sequence
  Synthetic polynucleotide
cgctcagcgtattagcaatagaaggag

SEQ ID NO: 11787 - DNA, 27 bp, Artificial Sequence
  Synthetic polynucleotide
accccgcaacaacagcattagctagag

SEQ ID NO: 11788 - DNA, 36 bp, Artificial Sequence
  Synthetic polynucleotide
ccgggttccggttcagaagttcgaaaaggcgacatg

SEQ ID NO: 11789 - DNA, 18 bp, Artificial Sequence
  Synthetic polynucleotide
aagtggctggctcccggt

SEQ ID NO: 11790 - DNA, 27 bp, Artificial Sequence
  Synthetic polynucleotide
cgttccagctccatatccgaaggacct

SEQ ID NO: 11791 - DNA, 27 bp, Artificial Sequence
  Synthetic polynucleotide
gtcactagaaatcagagccaaccaaaa

SEQ ID NO: 11792 - DNA, 54 bp, Artificial Sequence
  Synthetic polynucleotide
gctccgccattataccagggtcacggcttcattagcacccttttggcatcaccc

SEQ ID NO: 11793 - DNA, 27 bp, Artificial Sequence
  Synthetic polynucleotide
tatgattgaggtcaggtaaggccggag

SEQ ID NO: 11794 - DNA, 27 bp, Artificial Sequence
  Synthetic polynucleotide
gaatccttccgtgggacgaatagtgct

SEQ ID NO: 11795 - DNA, 36 bp, Artificial Sequence
  Synthetic polynucleotide
atcattcttaaaggggatgatcacactgacacagct

SEQ ID NO: 11796 - DNA, 18 bp, Artificial Sequence
  Synthetic polynucleotide
aatgcgagatctttacgc

SEQ ID NO: 11797 - DNA, 27 bp, Artificial Sequence
  Synthetic polynucleotide
gactgtgcgcatcttttatagccagat

SEQ ID NO: 11798 - DNA, 27 bp, Artificial Sequence
  Synthetic polynucleotide
cgcttatgctaagcttgggctgacaga

SEQ ID NO: 11799 - DNA, 36 bp, Artificial Sequence
  Synthetic polynucleotide
acggcggggtcgtccagcgatgttcaacatctcaaa

SEQ ID NO: 11800 - DNA, 45 bp, Artificial Sequence
  Synthetic polynucleotide
gcgtttgtcgcgcagggctcgacggtcagtcgtcgcataccaagg

SEQ ID NO: 11801 - DNA, 45 bp, Artificial Sequence
  Synthetic polynucleotide
ttggcgggccgaggatattgaacgagtcggcagttttggcaccag

SEQ ID NO: 11802 - DNA, 18 bp, Artificial Sequence
  Synthetic polynucleotide
actattaatacgtgccac

SEQ ID NO: 11803 - DNA, 17 bp, Artificial Sequence
  Synthetic polynucleotide
gaacagtcctttttttt

SEQ ID NO: 11804 - DNA, 27 bp, Artificial Sequence
  Synthetic polynucleotide
cgtccaagtcactatgtattaggcgaa

SEQ ID NO: 11805 - DNA, 27 bp, Artificial Sequence
  Synthetic polynucleotide
tagcgcccagtgaaacctagtctctgg

SEQ ID NO: 11806 - DNA, 27 bp, Artificial Sequence
  Synthetic polynucleotide
cccctcgagtttcctgtatagtcacat

SEQ ID NO: 11807 - DNA, 27 bp, Artificial Sequence
  Synthetic polynucleotide
ggctcgacagacagggagtcacccccg

SEQ ID NO: 11808 - DNA, 27 bp, Artificial Sequence
  Synthetic polynucleotide
ctccagaagtggtcgctgggaactcgc

SEQ ID NO: 11809 - DNA, 18 bp, Artificial Sequence
  Synthetic polynucleotide
cgcatcttttagctggtt

SEQ ID NO: 11810 - DNA, 17 bp, Artificial Sequence
  Synthetic polynucleotide
agatgtccgtttttttt

SEQ ID NO: 11811 - DNA, 27 bp, Artificial Sequence
  Synthetic polynucleotide
aacggatatcgggcgcataatcacaac

SEQ ID NO: 11812 - DNA, 27 bp, Artificial Sequence
  Synthetic polynucleotide
cagaagccccctagtttgatacttttc

SEQ ID NO: 11813 - DNA, 27 bp, Artificial Sequence
  Synthetic polynucleotide
attctcatgagctttggtgtatatccc

SEQ ID NO: 11814 - DNA, 27 bp, Artificial Sequence
  Synthetic polynucleotide
aagctgttcctgtttacatttagtgag

SEQ ID NO: 11815 - DNA, 27 bp, Artificial Sequence
  Synthetic polynucleotide
tccgaacttgactgctcttgtgtcacc

SEQ ID NO: 11816 - DNA, 18 bp, Artificial Sequence
  Synthetic polynucleotide
ggtagcgtacagggtgct

SEQ ID NO: 11817 - DNA, 54 bp, Artificial Sequence
  Synthetic polynucleotide
tttcacgcttacgtccaacaaggtagaggtattactcgatattcagattgccgg

SEQ ID NO: 11818 - DNA, 18 bp, Artificial Sequence
  Synthetic polynucleotide
tggtcgttataagctaat

SEQ ID NO: 11819 - DNA, 27 bp, Artificial Sequence
  Synthetic polynucleotide
cgtgctttcccgctgcctcctctcccc

SEQ ID NO: 11820 - DNA, 54 bp, Artificial Sequence
  Synthetic polynucleotide
aactaacgattatttcgaggtacacgtgataatcctcggaggtagcccactgtt

SEQ ID NO: 11821 - DNA, 18 bp, Artificial Sequence
  Synthetic polynucleotide
cagtcgagagagtcgtag

SEQ ID NO: 11822 - DNA, 18 bp, Artificial Sequence
  Synthetic polynucleotide
gtttcggaactagcggaa

SEQ ID NO: 11823 - DNA, 17 bp, Artificial Sequence
  Synthetic polynucleotide
ttttttttccaggagaa

SEQ ID NO: 11824 - DNA, 27 bp, Artificial Sequence
  Synthetic polynucleotide
ctgtttcacccgtcttaataagccacg

SEQ ID NO: 11825 - DNA, 27 bp, Artificial Sequence
  Synthetic polynucleotide
ccaggtggcaatcagttaccaaggcat

SEQ ID NO: 11826 - DNA, 36 bp, Artificial Sequence
  Synthetic polynucleotide
gagggggcactccccgaggcgtaatcggcgagtggg

SEQ ID NO: 11827 - DNA, 18 bp, Artificial Sequence
  Synthetic polynucleotide
gcggctgccgttaacgct

SEQ ID NO: 11828 - DNA, 27 bp, Artificial Sequence
  Synthetic polynucleotide
ataaccgagctttaagtaatccctgac

SEQ ID NO: 11829 - DNA, 27 bp, Artificial Sequence
  Synthetic polynucleotide
ttgacgagtttacaccggactttctgc

SEQ ID NO: 11830 - DNA, 27 bp, Artificial Sequence
  Synthetic polynucleotide
aaagcaggcttgcctccgagggttata

SEQ ID NO: 11831 - DNA, 36 bp, Artificial Sequence
  Synthetic polynucleotide
caatcgggttagctatggattaccgtgtcgttcgac

SEQ ID NO: 11832 - DNA, 18 bp, Artificial Sequence
  Synthetic polynucleotide
tggaatgcaaatatggga

SEQ ID NO: 11833 - DNA, 18 bp, Artificial Sequence
  Synthetic polynucleotide
cgactcacggagacaaca

SEQ ID NO: 11834 - DNA, 17 bp, Artificial Sequence
  Synthetic polynucleotide
tttttttttagtgggta

SEQ ID NO: 11835 - DNA, 27 bp, Artificial Sequence
  Synthetic polynucleotide
ccggtgagattcacttgcacatgtaag

SEQ ID NO: 11836 - DNA, 27 bp, Artificial Sequence
  Synthetic polynucleotide
caacggccaaaccatacctcagacgct

SEQ ID NO: 11837 - DNA, 36 bp, Artificial Sequence
  Synthetic polynucleotide
gcaaagaaactgatgtagtactgccactcctttgga

SEQ ID NO: 11838 - DNA, 18 bp, Artificial Sequence
  Synthetic polynucleotide
cccaggagtttcgagatt

SEQ ID NO: 11839 - DNA, 45 bp, Artificial Sequence
  Synthetic polynucleotide
tatagtttcatcaaaaattatggtttatccgaatgacgaggtgtc

SEQ ID NO: 11840 - DNA, 27 bp, Artificial Sequence
  Synthetic polynucleotide
gtgcgtaaggtcatatatattgaaagg

SEQ ID NO: 11841 - DNA, 27 bp, Artificial Sequence
  Synthetic polynucleotide
tccaaaccagtgcacagttatggataa

SEQ ID NO: 11842 - DNA, 36 bp, Artificial Sequence
  Synthetic polynucleotide
tagcaattgcctaatcccgtatatcaccttacatcg

SEQ ID NO: 11843 - DNA, 18 bp, Artificial Sequence
  Synthetic polynucleotide
aatgcaaccctatcttcg

SEQ ID NO: 11844 - DNA, 18 bp, Artificial Sequence
  Synthetic polynucleotide
tgtgcctacacggtgcag

SEQ ID NO: 11845 - DNA, 27 bp, Artificial Sequence
  Synthetic polynucleotide
ctgcgcgcctcaggctacagctttatt

SEQ ID NO: 11846 - DNA, 54 bp, Artificial Sequence
  Synthetic polynucleotide
ctcgcccactgccctcagcgactcttacgatttacggggttgtccccgaatact

SEQ ID NO: 11847 - DNA, 18 bp, Artificial Sequence
  Synthetic polynucleotide
ttagccgatcccagcgct

SEQ ID NO: 11848 - DNA, 45 bp, Artificial Sequence
  Synthetic polynucleotide
atgaactaactaagggagcactaatgagcccatgtatgtgatcga

SEQ ID NO: 11849 - DNA, 54 bp, Artificial Sequence
  Synthetic polynucleotide
ttccgcccctaatgaactccactctagcagaaccggggggcataataagcgcgt

SEQ ID NO: 11850 - DNA, 18 bp, Artificial Sequence
  Synthetic polynucleotide
ccagcccattgtcaagga

SEQ ID NO: 11851 - DNA, 45 bp, Artificial Sequence
  Synthetic polynucleotide
caccggttggttactgtacgtggggcacctcaatatcaaggtgac

SEQ ID NO: 11852 - DNA, 27 bp, Artificial Sequence
  Synthetic polynucleotide
gttgggtgtttactaaaacttaggggg

SEQ ID NO: 11853 - DNA, 18 bp, Artificial Sequence
  Synthetic polynucleotide
ttcagctctcggccatca

SEQ ID NO: 11854 - DNA, 27 bp, Artificial Sequence
  Synthetic polynucleotide
catgggaagcgggcactcccacgtttg

SEQ ID NO: 11855 - DNA, 36 bp, Artificial Sequence
  Synthetic polynucleotide
atacgacagtagaacgacccacaggtagtcgaccaa

SEQ ID NO: 11856 - DNA, 27 bp, Artificial Sequence
  Synthetic polynucleotide
tagtttgatcctatgatccaggaactt

SEQ ID NO: 11857 - DNA, 18 bp, Artificial Sequence
  Synthetic polynucleotide
cgctgtattcattacgtt

SEQ ID NO: 11858 - DNA, 27 bp, Artificial Sequence
  Synthetic polynucleotide
ctggcggtattagtactgttagcactt

SEQ ID NO: 11859 - DNA, 36 bp, Artificial Sequence
  Synthetic polynucleotide
cgccaataaggacaagaatggtttctagcagatctg

SEQ ID NO: 11860 - DNA, 27 bp, Artificial Sequence
  Synthetic polynucleotide
tgtttttgtcgggtatagctctcgttc

SEQ ID NO: 11861 - DNA, 18 bp, Artificial Sequence
  Synthetic polynucleotide
gtacaaatccgctttcta

SEQ ID NO: 11862 - DNA, 27 bp, Artificial Sequence
  Synthetic polynucleotide
ttcaccccgaggttaagtgggaggcta

SEQ ID NO: 11863 - DNA, 36 bp, Artificial Sequence
  Synthetic polynucleotide
gagaagccgcacgtgctgatgcacgattttatgtgg

SEQ ID NO: 11864 - DNA, 27 bp, Artificial Sequence
  Synthetic polynucleotide
atacacaaggcgatacaggttaggttt

SEQ ID NO: 11865 - DNA, 18 bp, Artificial Sequence
  Synthetic polynucleotide
aagagtatatggctgagc

SEQ ID NO: 11866 - DNA, 27 bp, Artificial Sequence
  Synthetic polynucleotide
cccccccgcttaaggaccatagatcag

SEQ ID NO: 11867 - DNA, 36 bp, Artificial Sequence
  Synthetic polynucleotide
ctacagtggagcgctcgactaccggaggcggacgac

SEQ ID NO: 11868 - DNA, 27 bp, Artificial Sequence
  Synthetic polynucleotide
tgcacttgggacacctttccgagatgt

SEQ ID NO: 11869 - DNA, 45 bp, Artificial Sequence
  Synthetic polynucleotide
cataattccttttttactgtccacgatggccggccattcgcgtat

SEQ ID NO: 11870 - DNA, 45 bp, Artificial Sequence
  Synthetic polynucleotide
gaggtctaccagaaactttaggatcccacatgatctagtccccaa

SEQ ID NO: 11871 - DNA, 45 bp, Artificial Sequence
  Synthetic polynucleotide
atcaccgctctagcctacactgcccctactcttaaatggttctgg

SEQ ID NO: 11872 - DNA, 18 bp, Artificial Sequence
  Synthetic polynucleotide
accgtggataatcgcgcg

SEQ ID NO: 11873 - DNA, 17 bp, Artificial Sequence
  Synthetic polynucleotide
taggacgattttttttt

SEQ ID NO: 11874 - DNA, 27 bp, Artificial Sequence
  Synthetic polynucleotide
tgcaggagatccgtcgtccgtgcagta

SEQ ID NO: 11875 - DNA, 27 bp, Artificial Sequence
  Synthetic polynucleotide
ttgacggtgctaccggcaaacattgga

SEQ ID NO: 11876 - DNA, 27 bp, Artificial Sequence
  Synthetic polynucleotide
cgttaaaagcacgcatatcagccgccg

SEQ ID NO: 11877 - DNA, 27 bp, Artificial Sequence
  Synthetic polynucleotide
gtcaagctgggtctaaagctcttgctt

SEQ ID NO: 11878 - DNA, 27 bp, Artificial Sequence
  Synthetic polynucleotide
cagtgattagcgtcttgcccgcgttga

SEQ ID NO: 11879 - DNA, 18 bp, Artificial Sequence
  Synthetic polynucleotide
gaccctgccgtcatgtca

SEQ ID NO: 11880 - DNA, 17 bp, Artificial Sequence
  Synthetic polynucleotide
ctgctggtgtttttttt

SEQ ID NO: 11881 - DNA, 27 bp, Artificial Sequence
  Synthetic polynucleotide
agttgtgggctcgacatctaggtttct

SEQ ID NO: 11882 - DNA, 27 bp, Artificial Sequence
  Synthetic polynucleotide
gatactgtactactgtcacggccctac

SEQ ID NO: 11883 - DNA, 27 bp, Artificial Sequence
  Synthetic polynucleotide
atcgccgccatgaaaaaagatccagtc

SEQ ID NO: 11884 - DNA, 27 bp, Artificial Sequence
  Synthetic polynucleotide
acgcgagcaaacggcgacgtaaccctt

SEQ ID NO: 11885 - DNA, 27 bp, Artificial Sequence
  Synthetic polynucleotide
tatataaaagccgtacgcggatgttgg

SEQ ID NO: 11886 - DNA, 18 bp, Artificial Sequence
  Synthetic polynucleotide
ggtctacgcgggaggtca

SEQ ID NO: 11887 - DNA, 54 bp, Artificial Sequence
  Synthetic polynucleotide
cgttcactcgcatcgcgtcgtacatacgttacttgggggtgaccgatgaacaac

SEQ ID NO: 11888 - DNA, 18 bp, Artificial Sequence
  Synthetic polynucleotide
tcatccaccaacgatctt

SEQ ID NO: 11889 - DNA, 27 bp, Artificial Sequence
  Synthetic polynucleotide
gaacgaaattagaaaaaggctgaggac

SEQ ID NO: 11890 - DNA, 54 bp, Artificial Sequence
  Synthetic polynucleotide
gtgtcctcacgcgccagacttagatcgcctggcccccgaaaactggtgcatctt

SEQ ID NO: 11891 - DNA, 18 bp, Artificial Sequence
  Synthetic polynucleotide
tcaacttacctacatgcg

SEQ ID NO: 11892 - DNA, 18 bp, Artificial Sequence
  Synthetic polynucleotide
cttcctactctgtccaga

SEQ ID NO: 11893 - DNA, 17 bp, Artificial Sequence
  Synthetic polynucleotide
ttttttttatgcagtcc

SEQ ID NO: 11894 - DNA, 27 bp, Artificial Sequence
  Synthetic polynucleotide
ttttcaactaatctcagccaacatttt

SEQ ID NO: 11895 - DNA, 27 bp, Artificial Sequence
  Synthetic polynucleotide
tcgagataagtgtcgaaaagcaggtcg

SEQ ID NO: 11896 - DNA, 36 bp, Artificial Sequence
  Synthetic polynucleotide
tacaggtccttctgcttaaacgaatgtaaaattcgc

SEQ ID NO: 11897 - DNA, 18 bp, Artificial Sequence
  Synthetic polynucleotide
tgccagttatcattcgta

SEQ ID NO: 11898 - DNA, 27 bp, Artificial Sequence
  Synthetic polynucleotide
cttgtctctcactaggtcgcctgtgag

SEQ ID NO: 11899 - DNA, 27 bp, Artificial Sequence
  Synthetic polynucleotide
tgaagcggcaaaccaatcgtcaacttt

SEQ ID NO: 11900 - DNA, 27 bp, Artificial Sequence
  Synthetic polynucleotide
tatcctttcgtcacttatgttgggagc

SEQ ID NO: 11901 - DNA, 36 bp, Artificial Sequence
  Synthetic polynucleotide
gcattaatacggtccggcatgccagcactcgttcgg

SEQ ID NO: 11902 - DNA, 18 bp, Artificial Sequence
  Synthetic polynucleotide
gttggcgcgtgggagaat

SEQ ID NO: 11903 - DNA, 18 bp, Artificial Sequence
  Synthetic polynucleotide
cgggaaacccacaacagt

SEQ ID NO: 11904 - DNA, 17 bp, Artificial Sequence
  Synthetic polynucleotide
ttttttttgacccgctc

SEQ ID NO: 11905 - DNA, 27 bp, Artificial Sequence
  Synthetic polynucleotide
acgtagttcatgccatgagattgcgcc

SEQ ID NO: 11906 - DNA, 27 bp, Artificial Sequence
  Synthetic polynucleotide
ccaattcatgacccgagaatggtttca

SEQ ID NO: 11907 - DNA, 36 bp, Artificial Sequence
  Synthetic polynucleotide
tcccgaggagcgtttaaagcaacctagaggccggac

SEQ ID NO: 11908 - DNA, 18 bp, Artificial Sequence
  Synthetic polynucleotide
cgtattaattgaacatct

SEQ ID NO: 11909 - DNA, 45 bp, Artificial Sequence
  Synthetic polynucleotide
gccacctgtgcgaatccttgctgggtacactaatggtgatctacc

SEQ ID NO: 11910 - DNA, 27 bp, Artificial Sequence
  Synthetic polynucleotide
aggtggtttgtttcgttttctgatata

SEQ ID NO: 11911 - DNA, 27 bp, Artificial Sequence
  Synthetic polynucleotide
tgacatcggctattcgcgcggaacatc

SEQ ID NO: 11912 - DNA, 36 bp, Artificial Sequence
  Synthetic polynucleotide
tgaatgggtatgcggcgcactacgctgttggacggg

SEQ ID NO: 11913 - DNA, 18 bp, Artificial Sequence
  Synthetic polynucleotide
aattcacagtgtaatgcg

SEQ ID NO: 11914 - DNA, 18 bp, Artificial Sequence
  Synthetic polynucleotide
cggtgtggaagcgctgcc

SEQ ID NO: 11915 - DNA, 27 bp, Artificial Sequence
  Synthetic polynucleotide
atggagaatcagggtgtatacgagctt

SEQ ID NO: 11916 - DNA, 18 bp, Artificial Sequence
  Synthetic polynucleotide
tccacaagggagccgaac

SEQ ID NO: 11917 - DNA, 27 bp, Artificial Sequence
  Synthetic polynucleotide
tatcccgagtggtttttaaggaatccg

SEQ ID NO: 11918 - DNA, 36 bp, Artificial Sequence
  Synthetic polynucleotide
cattacacgacgaccgggggtgaatcccatggacct

SEQ ID NO: 11919 - DNA, 27 bp, Artificial Sequence
  Synthetic polynucleotide
tataaagcttgatttaccccggaacag

SEQ ID NO: 11920 - DNA, 27 bp, Artificial Sequence
  Synthetic polynucleotide
tcgggaatttgaaaacgccagtagaat

SEQ ID NO: 11921 - DNA, 45 bp, Artificial Sequence
  Synthetic polynucleotide
ccgggctctaaagtttggaacagagcgagttcagacctgtaccga

SEQ ID NO: 11922 - DNA, 18 bp, Artificial Sequence
  Synthetic polynucleotide
ctccgaattactgtgctc

SEQ ID NO: 11923 - DNA, 27 bp, Artificial Sequence
  Synthetic polynucleotide
tacgccggggacggagaagcctgacag

SEQ ID NO: 11924 - DNA, 27 bp, Artificial Sequence
  Synthetic polynucleotide
acgcgataatagaatagacttgataga

SEQ ID NO: 11925 - DNA, 54 bp, Artificial Sequence
  Synthetic polynucleotide
ctaagccgccgtaatctggtgtgtccatatgaattgagattacggtatgattgg

SEQ ID NO: 11926 - DNA, 27 bp, Artificial Sequence
  Synthetic polynucleotide
tcaattcccgatcctgtaatgatcctc

SEQ ID NO: 11927 - DNA, 27 bp, Artificial Sequence
  Synthetic polynucleotide
cacttgtactatacgcttctcgtaggt

SEQ ID NO: 11928 - DNA, 36 bp, Artificial Sequence
  Synthetic polynucleotide
atggacggtattcttcgtaacttccctccacgctcg

SEQ ID NO: 11929 - DNA, 18 bp, Artificial Sequence
  Synthetic polynucleotide
atgcaaattattctgcta

SEQ ID NO: 11930 - DNA, 45 bp, Artificial Sequence
  Synthetic polynucleotide
cttattcggccatcccgggtgtcaccccttggactattcctcaag

SEQ ID NO: 11931 - DNA, 27 bp, Artificial Sequence
  Synthetic polynucleotide
attgcgtactagtgtcgatgctatggc

SEQ ID NO: 11932 - DNA, 54 bp, Artificial Sequence
  Synthetic polynucleotide
cgttactgtatgcccttgttttcggtacaaatagtactccatctgctatacact

SEQ ID NO: 11933 - DNA, 45 bp, Artificial Sequence
  Synthetic polynucleotide
ttcgcttttcagattccagtgcggcacaacttttatcatgcattt

SEQ ID NO: 11934 - DNA, 27 bp, Artificial Sequence
  Synthetic polynucleotide
ggtggctcgacgtagttaatgcagtta

SEQ ID NO: 11935 - DNA, 36 bp, Artificial Sequence
  Synthetic polynucleotide
taacaggaggtgctaggtccacatatctcttactcg

SEQ ID NO: 11936 - DNA, 59 bp, Artificial Sequence
  Synthetic polynucleotide
ttttttccaggttaagtggctcaatcatactcacggttaactgttgtgtcctatgttta

SEQ ID NO: 11937 - DNA, 58 bp, Artificial Sequence
  Synthetic polynucleotide
cttagggatggtttttttttttacgaactcaacgcacgctcgggtagtctcaagaaga

SEQ ID NO: 11938 - DNA, 60 bp, Artificial Sequence
  Synthetic polynucleotide
tagagagcataaattcgctaaaccggattttttttttttttttttttttaaagtatccgc

SEQ ID NO: 11939 - DNA, 42 bp, Artificial Sequence
  Synthetic polynucleotide
atctcactcagtgatcgagtattcatgtcgccttttcgaacg

SEQ ID NO: 11940 - DNA, 58 bp, Artificial Sequence
  Synthetic polynucleotide
gtgacacacttttttttttttgtgttcattcagagtagcggaaatatggccgcttcgg

SEQ ID NO: 11941 - DNA, 57 bp, Artificial Sequence
  Synthetic polynucleotide
tgcgcagcgggccgcctgtaacgcttattttttttttttttttttttttatcagccc

SEQ ID NO: 11942 - DNA, 45 bp, Artificial Sequence
  Synthetic polynucleotide
gggcttttgctaatacgctgagcgatgctgttgttgcggggtttc

SEQ ID NO: 11943 - DNA, 41 bp, Artificial Sequence
  Synthetic polynucleotide
tgaaccggaacttttttttttccgggctaatgaagccgtga

SEQ ID NO: 11944 - DNA, 52 bp, Artificial Sequence
  Synthetic polynucleotide
ccccagagactgtctgatgcaccgggagccagccacttagctgttttttttt

SEQ ID NO: 11945 - DNA, 49 bp, Artificial Sequence
  Synthetic polynucleotide
gtcagtgtgatcgcgagttccctctagctagggtgatgccaaaattttt

SEQ ID NO: 11946 - DNA, 54 bp, Artificial Sequence
  Synthetic polynucleotide
gggtggatatggttttttttttttttttttttttagctggaacggctctgattt

SEQ ID NO: 11947 - DNA, 41 bp, Artificial Sequence
  Synthetic polynucleotide
ctagtgacctggtataatggcggagctacctgacctcaatc

SEQ ID NO: 11948 - DNA, 58 bp, Artificial Sequence
  Synthetic polynucleotide
atacgtcccacggaaggattcatcccctttaagaatgttttttttttatcgcacagtc

SEQ ID NO: 11949 - DNA, 59 bp, Artificial Sequence
  Synthetic polynucleotide
tttgagatgttttttttttttttttttttttttgaacatcttttggttggcgtaaagat

SEQ ID NO: 11950 - DNA, 43 bp, Artificial Sequence
  Synthetic polynucleotide
ctcgcattctggtgccaaaactgccgactcgttcaagcactat

SEQ ID NO: 11951 - DNA, 58 bp, Artificial Sequence
  Synthetic polynucleotide
tatctggctataaaagatgtctgtcagcccaagcttattttttttttgcataagcggc

SEQ ID NO: 11952 - DNA, 59 bp, Artificial Sequence
  Synthetic polynucleotide
tggacgacccttttttttttttttttttttttcgccgtgcgacgactgaccgtcgagcc

SEQ ID NO: 11953 - DNA, 59 bp, Artificial Sequence
  Synthetic polynucleotide
tttttctgcgcgacaaacgcatatcctcggcccgccaaattaatagtcgattacgcttc

SEQ ID NO: 11954 - DNA, 59 bp, Artificial Sequence
  Synthetic polynucleotide
ttttttgcctaaaggtccttccacggtaatcgggggtgactccggcctccttggtatat

SEQ ID NO: 11955 - DNA, 58 bp, Artificial Sequence
  Synthetic polynucleotide
tagcttacccattttttttttctcgcgtggcacgtctacgactcgtcgaacgaggact

SEQ ID NO: 11956 - DNA, 60 bp, Artificial Sequence
  Synthetic polynucleotide
gttctacatagtgacttggacgaggtttttttttttttttttttttttttcactgggcgc

SEQ ID NO: 11957 - DNA, 42 bp, Artificial Sequence
  Synthetic polynucleotide
tatacaggaaactcgaggggctccctgtctgtcgagcccagc

SEQ ID NO: 11958 - DNA, 58 bp, Artificial Sequence
  Synthetic polynucleotide
gaccacttctgttttttttttgagaaagatgcggtggcagtagttgtgattagcttgg

SEQ ID NO: 11959 - DNA, 60 bp, Artificial Sequence
  Synthetic polynucleotide
gggtgatatacctcactaaactccttctttttttttttttttttttttttaatgtgacta

SEQ ID NO: 11960 - DNA, 42 bp, Artificial Sequence
  Synthetic polynucleotide
agcgttaactccaaaggaaaccagctatcccatattcgatgt

SEQ ID NO: 11961 - DNA, 49 bp, Artificial Sequence
  Synthetic polynucleotide
aagcggacatctttttttttttatgcgcccgatatccgttcaaactagg

SEQ ID NO: 11962 - DNA, 44 bp, Artificial Sequence
  Synthetic polynucleotide
gggcttctgaccaaagctcatgagaattgtaaacagtttttttt

SEQ ID NO: 11963 - DNA, 58 bp, Artificial Sequence
  Synthetic polynucleotide
gaacagcttagagcagtcaagttcggatacgctacctatggacggggatatgcttttt

SEQ ID NO: 11964 - DNA, 60 bp, Artificial Sequence
  Synthetic polynucleotide
gacaccatgatccggatgagttatgaattttttttttttttttttttttgatcgtcattg

SEQ ID NO: 11965 - DNA, 41 bp, Artificial Sequence
  Synthetic polynucleotide
ggatatacaatctcgaagtaaagcatagcaccctgcgaaga

SEQ ID NO: 11966 - DNA, 58 bp, Artificial Sequence
  Synthetic polynucleotide
tagggtcacagttttttttttcagtaatacctctaccttgttggacgtaagcgtgaaa

SEQ ID NO: 11967 - DNA, 60 bp, Artificial Sequence
  Synthetic polynucleotide
taacgaccagaaagcacgaggattatcttttttttttttttttttttttacgtgtacctc

SEQ ID NO: 11968 - DNA, 41 bp, Artificial Sequence
  Synthetic polynucleotide
gaaataatcgttagtttctcgactgttccgaaacaggcagc

SEQ ID NO: 11969 - DNA, 58 bp, Artificial Sequence
  Synthetic polynucleotide
ggtagcctcccttttttttttacttaacctatgccttggtaactgattttctcctggt

SEQ ID NO: 11970 - DNA, 54 bp, Artificial Sequence
  Synthetic polynucleotide
tccgctagctgatctatggtttttttttttttttttttttttccttaatataac

SEQ ID NO: 11971 - DNA, 49 bp, Artificial Sequence
  Synthetic polynucleotide
tttttcctcggaggcaaggggagagggtgaaacaggccacctggctcgg

SEQ ID NO: 11972 - DNA, 59 bp, Artificial Sequence
  Synthetic polynucleotide
ttttttggagtgccccctcggcagccgcctcggttatactcgtcaagcctgctttccat

SEQ ID NO: 11973 - DNA, 58 bp, Artificial Sequence
  Synthetic polynucleotide
agctaacccgattttttttttttgtgcattccacgtgagtcgtacttaaagcaaacgt

SEQ ID NO: 11974 - DNA, 60 bp, Artificial Sequence
  Synthetic polynucleotide
gggagtgcccgagcgtctgaggtatggtttttttttttttttttttttttttacccacta

SEQ ID NO: 11975 - DNA, 42 bp, Artificial Sequence
  Synthetic polynucleotide
tgttgtctcaagtgctaacagtactaattatccataactgtg

SEQ ID NO: 11976 - DNA, 58 bp, Artificial Sequence
  Synthetic polynucleotide
cacgtcagggattttttttttttctcaccggtggccgttgctacatcagtttctttgc

SEQ ID NO: 11977 - DNA, 60 bp, Artificial Sequence
  Synthetic polynucleotide
actcctggggaaactatacttacgcactttttttttttttttttttttttggtttggagg

SEQ ID NO: 11978 - DNA, 42 bp, Artificial Sequence
  Synthetic polynucleotide
gattaggcaattgctaggttgcattgtaggcacaatttttga

SEQ ID NO: 11979 - DNA, 49 bp, Artificial Sequence
  Synthetic polynucleotide
ttcgatcacatttttttttttacatgggcaataaagctgtagcctgagg

SEQ ID NO: 11980 - DNA, 44 bp, Artificial Sequence
  Synthetic polynucleotide
cgcgcagctgcaccgtgtcaccttgatattgagggatttttttt

SEQ ID NO: 11981 - DNA, 58 bp, Artificial Sequence
  Synthetic polynucleotide
cacctcgtcattcggataaaccatactgagggcagtgggcgagatcggctaatttttt

SEQ ID NO: 11982 - DNA, 60 bp, Artificial Sequence
  Synthetic polynucleotide
cattagtgctcccttagttagttcatattttttttttttttttttttttgttcattaggg

SEQ ID NO: 11983 - DNA, 40 bp, Artificial Sequence
  Synthetic polynucleotide
gcggaaatgggctggtgccccacgtacagtaaccaaccgg

SEQ ID NO: 11984 - DNA, 58 bp, Artificial Sequence
  Synthetic polynucleotide
tgtacctgtggttttttttttgtagggccgagcgctgggcttacatgtgcaagtgaaa

SEQ ID NO: 11985 - DNA, 60 bp, Artificial Sequence
  Synthetic polynucleotide
tatatgacttggtcgaccagatctgctttttttttttttttttttttttagaaaccacca

SEQ ID NO: 11986 - DNA, 41 bp, Artificial Sequence
  Synthetic polynucleotide
acatcctccttgacacctttcaatttttagtaaacacccaa

SEQ ID NO: 11987 - DNA, 58 bp, Artificial Sequence
  Synthetic polynucleotide
cagagctgaacttttttttttttcccatggtcgttctactgtcgtatgatcataggat

SEQ ID NO: 11988 - DNA, 54 bp, Artificial Sequence
  Synthetic polynucleotide
caaactaaatacagcgtaccttttttttttttttttttttttgccagttcttgt

SEQ ID NO: 11989 - DNA, 49 bp, Artificial Sequence
  Synthetic polynucleotide
tttttccttattggcgatcgtgcattccaatgtttgatggccgcgtggc

SEQ ID NO: 11990 - DNA, 48 bp, Artificial Sequence
  Synthetic polynucleotide
cacttaacctggtccggtttgcacggcgacatctcacccagtgagaag

SEQ ID NO: 11991 - DNA, 48 bp, Artificial Sequence
  Synthetic polynucleotide
gtgatattaatttggcgggcgccggagttcgttcgagaacagtcgaga

SEQ ID NO: 11992 - DNA, 48 bp, Artificial Sequence
  Synthetic polynucleotide
gactttatagccgttttggcgacagggactaatcacctatgcttcgct

SEQ ID NO: 11993 - DNA, 27 bp, Artificial Sequence
  Synthetic polynucleotide
ttgagttcgtaccatcccttcgcgcag

SEQ ID NO: 11994 - DNA, 48 bp, Artificial Sequence
  Synthetic polynucleotide
cgatagtcggcaagataggcaacagtcccacccccggccaggtggcct

SEQ ID NO: 11995 - DNA, 44 bp, Artificial Sequence
  Synthetic polynucleotide
gtgtgcttatgctaagcttgcacgcgagtgggtaagctccgagg

SEQ ID NO: 11996 - DNA, 44 bp, Artificial Sequence
  Synthetic polynucleotide
cgttgatgttcaccatatcctcacattactgtttactgacgatc

SEQ ID NO: 11997 - DNA, 48 bp, Artificial Sequence
  Synthetic polynucleotide
ccatccgtgggagccattatgatagctggccccctatatccgaacttg

SEQ ID NO: 11998 - DNA, 28 bp, Artificial Sequence
  Synthetic polynucleotide
gcccgggctgatacagctaattccagct

SEQ ID NO: 11999 - DNA, 48 bp, Artificial Sequence
  Synthetic polynucleotide
cagcgtagctcccgtatatccccccaaggcccctcgttaaccaggaga

SEQ ID NO: 12000 - DNA, 40 bp, Artificial Sequence
  Synthetic polynucleotide
cggttgtgcgatcattcttatctttctccagaagtgggtt

SEQ ID NO: 12001 - DNA, 48 bp, Artificial Sequence
  Synthetic polynucleotide
ctctgaactcgcgatcacacggtcagaagtttccttgtctttcatact

SEQ ID NO: 12002 - DNA, 44 bp, Artificial Sequence
  Synthetic polynucleotide
ttttggcaggcgcatagatgtccgtattactgctgtgaccggtg

SEQ ID NO: 12003 - DNA, 44 bp, Artificial Sequence
  Synthetic polynucleotide
gggtcgtcctttaggcaacctcgttattaagggataatcctggg

SEQ ID NO: 12004 - DNA, 48 bp, Artificial Sequence
  Synthetic polynucleotide
ggaccagaagcgcagtcgtcagcgaattgagatgcggatacttttaag

SEQ ID NO: 12005 - DNA, 48 bp, Artificial Sequence
  Synthetic polynucleotide
ggagcgaggatagacatcttacccgagcgaaaaggcgacatgaagcgg

SEQ ID NO: 12006 - DNA, 32 bp, Artificial Sequence
  Synthetic polynucleotide
gtagtcgacggttaatcgacgtatgattgagc

SEQ ID NO: 12007 - DNA, 48 bp, Artificial Sequence
  Synthetic polynucleotide
gtgcggctgacatgcgtttgaagtaaacataggacacaacagttttga

SEQ ID NO: 12008 - DNA, 32 bp, Artificial Sequence
  Synthetic polynucleotide
agcgaaatagtgaaccaaaaacaggcggaaaa

SEQ ID NO: 12009 - DNA, 48 bp, Artificial Sequence
  Synthetic polynucleotide
gacaaccagaatgaatccttatttccgccccgcaacaacagcatcagt

SEQ ID NO: 12010 - DNA, 44 bp, Artificial Sequence
  Synthetic polynucleotide
gagtgtacacgtttcataacccaaaccatccctcaataatgaac

SEQ ID NO: 12011 - DNA, 48 bp, Artificial Sequence
  Synthetic polynucleotide
atcatttacgcccttgaacgcactgagttatgctctctatcttcaacc

SEQ ID NO: 12012 - DNA, 33 bp, Artificial Sequence
  Synthetic polynucleotide
cgcaaaggggatgcgaggcccaccgttcgtgcg

SEQ ID NO: 12013 - DNA, 48 bp, Artificial Sequence
  Synthetic polynucleotide
ttagacccgattcagagccggtggctggctcccggtgcatcagacgct

SEQ ID NO: 12014 - DNA, 48 bp, Artificial Sequence
  Synthetic polynucleotide
atggaccaggtcgctagaggggggtcacggcttcattagcccgggttc

SEQ ID NO: 12015 - DNA, 48 bp, Artificial Sequence
  Synthetic polynucleotide
cttttgacaaatgaggtcaggtattagccccgctgcgcaccgaatact

SEQ ID NO: 12016 - DNA, 48 bp, Artificial Sequence
  Synthetic polynucleotide
atcgtcaccctaactaggactcagaaactactctgaatgaacacaagt

SEQ ID NO: 12017 - DNA, 48 bp, Artificial Sequence
  Synthetic polynucleotide
actgtgcagctgcaacctagatgtttcaggcaccagcccatttccaag

SEQ ID NO: 12018 - DNA, 52 bp, Artificial Sequence
  Synthetic polynucleotide
gcatatccgcccatgtatgtgatcggccctacccacaggtacaccggtagaa

SEQ ID NO: 12019 - DNA, 48 bp, Artificial Sequence
  Synthetic polynucleotide
tacgctacaatgcgcgcctctcagtatggtttatccgaatgacggagc

SEQ ID NO: 12020 - DNA, 48 bp, Artificial Sequence
  Synthetic polynucleotide
tcgaagtgcaaactgttagcataatcctaaaggtgtcaaggaggtttg

SEQ ID NO: 12021 - DNA, 48 bp, Artificial Sequence
  Synthetic polynucleotide
aaataattagtagaaactgagtacgtggcttgcacatgtaagcccact

SEQ ID NO: 12022 - DNA, 36 bp, Artificial Sequence
  Synthetic polynucleotide
aagtgggaggctatgcacaatcgggttacaataagg

SEQ ID NO: 12023 - DNA, 48 bp, Artificial Sequence
  Synthetic polynucleotide
aactcccacgtttataaccgcgcggccatcaaacattggaatgctgtt

SEQ ID NO: 12024 - DNA, 52 bp, Artificial Sequence
  Synthetic polynucleotide
accatagaggcactccccatacctgaactggcagcagatctggtcgaccgct

SEQ ID NO: 12025 - DNA, 48 bp, Artificial Sequence
  Synthetic polynucleotide
gtttttgacgagtgctttaaaaaaattgatgatcatacgacagttggt

SEQ ID NO: 12026 - DNA, 40 bp, Artificial Sequence
  Synthetic polynucleotide
taaagtgcgtaatggtttcttatgaactaactaaggaggt

SEQ ID NO: 12027 - DNA, 40 bp, Artificial Sequence
  Synthetic polynucleotide
agaatccctgaccatgggaagttcagctctgttgggacga

SEQ ID NO: 12028 - DNA, 48 bp, Artificial Sequence
  Synthetic polynucleotide
gccctatcaaggtgacacggctctaagcatcatggttggagttagtat

SEQ ID NO: 12029 - DNA, 48 bp, Artificial Sequence
  Synthetic polynucleotide
gcccaggctacagctttattccgtccatggtagaggcttacatcccac

SEQ ID NO: 12030 - DNA, 20 bp, Artificial Sequence
  Synthetic polynucleotide
attagccgatctcgcccagc

SEQ ID NO: 12031 - DNA, 48 bp, Artificial Sequence
  Synthetic polynucleotide
actacaattgcctccccagggattgtattctggtcgagtttcctctat

SEQ ID NO: 12032 - DNA, 48 bp, Artificial Sequence
  Synthetic polynucleotide
gctcgaatcaaacggccaccctatcttcaaggcatagtcgctggagac

SEQ ID NO: 12033 - DNA, 48 bp, Artificial Sequence
  Synthetic polynucleotide
ttgggtatagtttaatcccttcatccggtgttccaaaattctcatgag

SEQ ID NO: 12034 - DNA, 48 bp, Artificial Sequence
  Synthetic polynucleotide
tacttgtagcaaaattgtgctccaacaaaggtagcggtttgaacggat

SEQ ID NO: 12035 - DNA, 48 bp, Artificial Sequence
  Synthetic polynucleotide
tcatacttgagacgggcactaacgattacggaccgaattaccgtggaa

SEQ ID NO: 12036 - DNA, 48 bp, Artificial Sequence
  Synthetic polynucleotide
cgacgtgcacagcacgtggaaccgctgcccccttgcctaatataccaa

SEQ ID NO: 12037 - DNA, 48 bp, Artificial Sequence
  Synthetic polynucleotide
acaacagacgctcaacatagtcgtgcttatcctgagttagtgagacgc

SEQ ID NO: 12038 - DNA, 48 bp, Artificial Sequence
  Synthetic polynucleotide
tactgtacgactttatggatcagttaccgcagggtgaactactggaat

SEQ ID NO: 12039 - DNA, 20 bp, Artificial Sequence
  Synthetic polynucleotide
ggtacgctgtatttagatgt

SEQ ID NO: 12040 - DNA, 48 bp, Artificial Sequence
  Synthetic polynucleotide
gccaaggcggctgccgagggtcagctagtttcgttaccaagtcagtat

SEQ ID NO: 12041 - DNA, 48 bp, Artificial Sequence
  Synthetic polynucleotide
tcgcgctatggaaagcaggccaccctctctgtttcgcgagtcgtgctc

SEQ ID NO: 12042 - DNA, 32 bp, Artificial Sequence
  Synthetic polynucleotide
ccaggttaagtggctcaatcatactcacggtt

SEQ ID NO: 12043 - DNA, 32 bp, Artificial Sequence; identical to SEQ ID NO: 3
  Synthetic polynucleotide

SEQ ID NO: 12044 - DNA, 32 bp, Artificial Sequence; identical to SEQ ID NO: 4
  Synthetic polynucleotide

SEQ ID NO: 12045 - DNA, 32 bp, Artificial Sequence; identical to SEQ ID NO: 5
  Synthetic polynucleotide

SEQ ID NO: 12046 - DNA, 32 bp, Artificial Sequence; identical to SEQ ID NO: 6
  Synthetic polynucleotide

SEQ ID NO: 12047 - DNA, 32 bp, Artificial Sequence; identical to SEQ ID NO: 7
  Synthetic polynucleotide

SEQ ID NO: 12048 - DNA, 32 bp, Artificial Sequence; identical to SEQ ID NO: 8
  Synthetic polynucleotide

SEQ ID NO: 12049 - DNA, 32 bp, Artificial Sequence; identical to SEQ ID NO: 9
  Synthetic polynucleotide

SEQ ID NO: 12050 - DNA, 32 bp, Artificial Sequence; identical to SEQ ID NO: 10
  Synthetic polynucleotide

SEQ ID NO: 12051 - DNA, 32 bp, Artificial Sequence; identical to SEQ ID NO: 11
  Synthetic polynucleotide

SEQ ID NO: 12052 - DNA, 32 bp, Artificial Sequence; identical to SEQ ID NO: 1901
  Synthetic polynucleotide

SEQ ID NO: 12053 - DNA, 32 bp, Artificial Sequence; identical to SEQ ID NO: 1902
  Synthetic polynucleotide

SEQ ID NO: 12054 - DNA, 32 bp, Artificial Sequence; identical to SEQ ID NO: 348
  Synthetic polynucleotide

SEQ ID NO: 12055 - DNA, 32 bp, Artificial Sequence; identical to SEQ ID NO: 17
  Synthetic polynucleotide

SEQ ID NO: 12056 - DNA, 32 bp, Artificial Sequence; identical to SEQ ID NO: 18
  Synthetic polynucleotide

SEQ ID NO: 12057 - DNA, 32 bp, Artificial Sequence; identical to SEQ ID NO: 19
  Synthetic polynucleotide

SEQ ID NO: 12058 - DNA, 32 bp, Artificial Sequence; identical to SEQ ID NO: 20
  Synthetic polynucleotide

SEQ ID NO: 12059 - DNA, 32 bp, Artificial Sequence; identical to SEQ ID NO: 21
  Synthetic polynucleotide

SEQ ID NO: 12060 - DNA, 32 bp, Artificial Sequence; identical to SEQ ID NO: 22
  Synthetic polynucleotide

SEQ ID NO: 12061 - DNA, 32 bp, Artificial Sequence; identical to SEQ ID NO: 23
  Synthetic polynucleotide

SEQ ID NO: 12062 - DNA, 32 bp, Artificial Sequence; identical to SEQ ID NO: 24
  Synthetic polynucleotide

SEQ ID NO: 12063 - DNA, 32 bp, Artificial Sequence; identical to SEQ ID NO: 3319
  Synthetic polynucleotide

SEQ ID NO: 12064 - DNA, 32 bp, Artificial Sequence; identical to SEQ ID NO: 4430
  Synthetic polynucleotide

SEQ ID NO: 12065 - DNA, 32 bp, Artificial Sequence; identical to SEQ ID NO: 28
  Synthetic polynucleotide

SEQ ID NO: 12066 - DNA, 32 bp, Artificial Sequence; identical to SEQ ID NO: 4534
  Synthetic polynucleotide

SEQ ID NO: 12067 - DNA, 32 bp, Artificial Sequence; identical to SEQ ID NO: 31
  Synthetic polynucleotide

SEQ ID NO: 12068 - DNA, 32 bp, Artificial Sequence; identical to SEQ ID NO: 32
  Synthetic polynucleotide

SEQ ID NO: 12069 - DNA, 32 bp, Artificial Sequence; identical to SEQ ID NO: 33
  Synthetic polynucleotide

SEQ ID NO: 12070 - DNA, 32 bp, Artificial Sequence; identical to SEQ ID NO: 34
  Synthetic polynucleotide

SEQ ID NO: 12071 - DNA, 32 bp, Artificial Sequence; identical to SEQ ID NO: 35
  Synthetic polynucleotide

SEQ ID NO: 12072 - DNA, 32 bp, Artificial Sequence; identical to SEQ ID NO: 36
  Synthetic polynucleotide

SEQ ID NO: 12073 - DNA, 32 bp, Artificial Sequence; identical to SEQ ID NO: 37
  Synthetic polynucleotide

SEQ ID NO: 12074 - DNA, 32 bp, Artificial Sequence; identical to SEQ ID NO: 38
  Synthetic polynucleotide

SEQ ID NO: 12075 - DNA, 32 bp, Artificial Sequence; identical to SEQ ID NO: 39
  Synthetic polynucleotide

SEQ ID NO: 12076 - DNA, 32 bp, Artificial Sequence; identical to SEQ ID NO: 1922
  Synthetic polynucleotide

SEQ ID NO: 12077 - DNA, 32 bp, Artificial Sequence; identical to SEQ ID NO: 1923
  Synthetic polynucleotide

SEQ ID NO: 12078 - DNA, 32 bp, Artificial Sequence; identical to SEQ ID NO: 370
  Synthetic polynucleotide

SEQ ID NO: 12079 - DNA, 32 bp, Artificial Sequence; identical to SEQ ID NO: 45
  Synthetic polynucleotide

SEQ ID NO: 12080 - DNA, 32 bp, Artificial Sequence; identical to SEQ ID NO: 46
  Synthetic polynucleotide

SEQ ID NO: 12081 - DNA, 32 bp, Artificial Sequence; identical to SEQ ID NO: 47
  Synthetic polynucleotide

SEQ ID NO: 12082 - DNA, 32 bp, Artificial Sequence; identical to SEQ ID NO: 48
  Synthetic polynucleotide

SEQ ID NO: 12083 - DNA, 32 bp, Artificial Sequence; identical to SEQ ID NO: 49
  Synthetic polynucleotide

SEQ ID NO: 12084 - DNA, 32 bp, Artificial Sequence; identical to SEQ ID NO: 50
  Synthetic polynucleotide

SEQ ID NO: 12085 - DNA, 32 bp, Artificial Sequence; identical to SEQ ID NO: 51
  Synthetic polynucleotide

SEQ ID NO: 12086 - DNA, 32 bp, Artificial Sequence; identical to SEQ ID NO: 52
  Synthetic polynucleotide

SEQ ID NO: 12087 - DNA, 32 bp, Artificial Sequence; identical to SEQ ID NO: 3607
  Synthetic polynucleotide

SEQ ID NO: 12088 - DNA, 32 bp, Artificial Sequence; identical to SEQ ID NO: 3904
  Synthetic polynucleotide

SEQ ID NO: 12089 - DNA, 32 bp, Artificial Sequence; identical to SEQ ID NO: 56
  Synthetic polynucleotide

SEQ ID NO: 12090 - DNA, 32 bp, Artificial Sequence; identical to SEQ ID NO: 3964
  Synthetic polynucleotide

SEQ ID NO: 12091 - DNA, 32 bp, Artificial Sequence; identical to SEQ ID NO: 59
  Synthetic polynucleotide

SEQ ID NO: 12092 - DNA, 32 bp, Artificial Sequence; identical to SEQ ID NO: 60
  Synthetic polynucleotide

SEQ ID NO: 12093 - DNA, 32 bp, Artificial Sequence; identical to SEQ ID NO: 61
  Synthetic polynucleotide

SEQ ID NO: 12094 - DNA, 32 bp, Artificial Sequence; identical to SEQ ID NO: 62
  Synthetic polynucleotide

SEQ ID NO: 12095 - DNA, 32 bp, Artificial Sequence; identical to SEQ ID NO: 63
  Synthetic polynucleotide

SEQ ID NO: 12096 - DNA, 32 bp, Artificial Sequence; identical to SEQ ID NO: 64
  Synthetic polynucleotide

SEQ ID NO: 12097 - DNA, 32 bp, Artificial Sequence; identical to SEQ ID NO: 65
  Synthetic polynucleotide

SEQ ID NO: 12098 - DNA, 32 bp, Artificial Sequence; identical to SEQ ID NO: 66
  Synthetic polynucleotide

SEQ ID NO: 12099 - DNA, 32 bp, Artificial Sequence; identical to SEQ ID NO: 67
  Synthetic polynucleotide

SEQ ID NO: 12100 - DNA, 32 bp, Artificial Sequence; identical to SEQ ID NO: 1943
  Synthetic polynucleotide

SEQ ID NO: 12101 - DNA, 32 bp, Artificial Sequence; identical to SEQ ID NO: 936
  Synthetic polynucleotide

SEQ ID NO: 12102 - DNA, 32 bp, Artificial Sequence; identical to SEQ ID NO: 392
  Synthetic polynucleotide

SEQ ID NO: 12103 - DNA, 32 bp, Artificial Sequence; identical to SEQ ID NO: 73
  Synthetic polynucleotide

SEQ ID NO: 12104 - DNA, 32 bp, Artificial Sequence; identical to SEQ ID NO: 74
  Synthetic polynucleotide

SEQ ID NO: 12105 - DNA, 32 bp, Artificial Sequence; identical to SEQ ID NO: 75
  Synthetic polynucleotide

SEQ ID NO: 12106 - DNA, 32 bp, Artificial Sequence; identical to SEQ ID NO: 76
  Synthetic polynucleotide

SEQ ID NO: 12107 - DNA, 32 bp, Artificial Sequence; identical to SEQ ID NO: 77
  Synthetic polynucleotide

SEQ ID NO: 12108 - DNA, 32 bp, Artificial Sequence; identical to SEQ ID NO: 78
  Synthetic polynucleotide

SEQ ID NO: 12109 - DNA, 32 bp, Artificial Sequence; identical to SEQ ID NO: 157
  Synthetic polynucleotide

SEQ ID NO: 12110 - DNA, 32 bp, Artificial Sequence; identical to SEQ ID NO: 158
  Synthetic polynucleotide

SEQ ID NO: 12111 - DNA, 32 bp, Artificial Sequence; identical to SEQ ID NO: 4377
  Synthetic polynucleotide

SEQ ID NO: 12112 - DNA, 32 bp, Artificial Sequence; identical to SEQ ID NO: 4432
  Synthetic polynucleotide

SEQ ID NO: 12113 - DNA, 32 bp, Artificial Sequence; identical to SEQ ID NO: 162
  Synthetic polynucleotide

SEQ ID NO: 12114 - DNA, 32 bp, Artificial Sequence
  Synthetic polynucleotide
gagccacttaacctggtactttggcacctgtc

SEQ ID NO: 12115 - DNA, 32 bp, Artificial Sequence
  Synthetic polynucleotide
ataggacacaacagttaagtccagataaacta

SEQ ID NO: 12116 - DNA, 32 bp, Artificial Sequence
  Synthetic polynucleotide
gagatgcggatacgtaaacctatgcgttagaa

SEQ ID NO: 12117 - DNA, 32 bp, Artificial Sequence
  Synthetic polynucleotide
gaaaaggcgacacttcccatcgtaatcgtagt

SEQ ID NO: 12118 - DNA, 32 bp, Artificial Sequence
  Synthetic polynucleotide
gtgcgttgagttctttcgcttataccagtggg

SEQ ID NO: 12119 - DNA, 32 bp, Artificial Sequence
  Synthetic polynucleotide
tatgctctctattgaagttcgacgtatgcggc

SEQ ID NO: 12120 - DNA, 32 bp, Artificial Sequence
  Synthetic polynucleotide
aaaagcccgggcacacttgagctaagctgtca

SEQ ID NO: 12121 - DNA, 32 bp, Artificial Sequence
  Synthetic polynucleotide
cccgcaacaacacgaatccgtcgtcgcaattg

SEQ ID NO: 12122 - DNA, 32 bp, Artificial Sequence
  Synthetic polynucleotide
tactctgaatgatgatcagtgctagaggtaaa

SEQ ID NO: 12123 - DNA, 32 bp, Artificial Sequence
  Synthetic polynucleotide
cccgctgcgcacgcatacagagctccatgttc

SEQ ID NO: 12124 - DNA, 32 bp, Artificial Sequence
  Synthetic polynucleotide
ggcttcattagcccgggcggatcattctgaac

SEQ ID NO: 12125 - DNA, 32 bp, Artificial Sequence
  Synthetic polynucleotide
ctcccggtgcatcagataagcaaaagatatcc

SEQ ID NO: 12126 - DNA, 32 bp, Artificial Sequence
  Synthetic polynucleotide
tcgcatcgggcgcatactaaagaggtatttga

SEQ ID NO: 12127 - DNA, 32 bp, Artificial Sequence
  Synthetic polynucleotide
acccctttggtcagaagaagggtcgttacata

SEQ ID NO: 12128 - DNA, 32 bp, Artificial Sequence
  Synthetic polynucleotide
ggggcgcatcttattagcccatccgaactact

SEQ ID NO: 12129 - DNA, 32 bp, Artificial Sequence
  Synthetic polynucleotide
aacaatcaccccgctgctgttggtgtcgtttc

SEQ ID NO: 12130 - DNA, 32 bp, Artificial Sequence
  Synthetic polynucleotide
ctagttagtcactctctcgtggcatagggatc

SEQ ID NO: 12131 - DNA, 32 bp, Artificial Sequence
  Synthetic polynucleotide
aggtatgggatacaagaaccgctagcggtgct

SEQ ID NO: 12132 - DNA, 32 bp, Artificial Sequence
  Synthetic polynucleotide
ctgagtgccacggtgagtttccaatgacttaa

SEQ ID NO: 12133 - DNA, 32 bp, Artificial Sequence
  Synthetic polynucleotide
gggggtagaacagggagatggggtgctaaacc

SEQ ID NO: 12134 - DNA, 32 bp, Artificial Sequence
  Synthetic polynucleotide
tgcgagcgcccacgagcacccctccgagcacg

SEQ ID NO: 12135 - DNA, 32 bp, Artificial Sequence
  Synthetic polynucleotide
gcttgacagacagtcctgggagccaggtacag

SEQ ID NO: 12136 - DNA, 32 bp, Artificial Sequence
  Synthetic polynucleotide
gcgcggacctttaggcgccctcgaggtaggtt

SEQ ID NO: 12137 - DNA, 32 bp, Artificial Sequence
  Synthetic polynucleotide
ttaaggaggccggagtcagagtttcggaggcc

SEQ ID NO: 12138 - DNA, 32 bp, Artificial Sequence
  Synthetic polynucleotide
ttttttttttttttttagttcgatcacttttt

SEQ ID NO: 12139 - DNA, 32 bp, Artificial Sequence
  Synthetic polynucleotide
ggaaagggctcgacggataggtgtcaccgatt

SEQ ID NO: 12140 - DNA, 32 bp, Artificial Sequence
  Synthetic polynucleotide
ccaatttggcgggccgttttttttttttaaac

SEQ ID NO: 12141 - DNA, 32 bp, Artificial Sequence
  Synthetic polynucleotide
gtatagatctttttttttttttttttttgagt

SEQ ID NO: 12142 - DNA, 32 bp, Artificial Sequence
  Synthetic polynucleotide
gctcgaacgagtttttaggagtgagtatgttc

SEQ ID NO: 12143 - DNA, 32 bp, Artificial Sequence
  Synthetic polynucleotide
ttttttttttttccgcgaagccctaagttttt

SEQ ID NO: 12144 - DNA, 32 bp, Artificial Sequence
  Synthetic polynucleotide
ttttttttttttacgcccatcagcgtattttt

SEQ ID NO: 12145 - DNA, 32 bp, Artificial Sequence
  Synthetic polynucleotide
agaccagacatccggcgtggcggttcaggagc

SEQ ID NO: 12146 - DNA, 32 bp, Artificial Sequence
  Synthetic polynucleotide
ctattcgtccagttttttttttttttttaatt

SEQ ID NO: 12147 - DNA, 32 bp, Artificial Sequence
  Synthetic polynucleotide
acgcaaatcagatttttttttttttttttagc

SEQ ID NO: 12148 - DNA, 32 bp, Artificial Sequence
  Synthetic polynucleotide
gaatcaggtagcttccttatgactacccaaac

SEQ ID NO: 12149 - DNA, 32 bp, Artificial Sequence
  Synthetic polynucleotide
ttttttttttttactgtcaggtttagcgtttt

SEQ ID NO: 12150 - DNA, 32 bp, Artificial Sequence
  Synthetic polynucleotide
ttttttttttttgccgcctactctggggtttt

SEQ ID NO: 12151 - DNA, 32 bp, Artificial Sequence
  Synthetic polynucleotide
ccacatgaatcctccgttccctaagtggccgc

SEQ ID NO: 12152 - DNA, 32 bp, Artificial Sequence
  Synthetic polynucleotide
gtattctcaaagttttttttttttttttgcgg

SEQ ID NO: 12153 - DNA, 32 bp, Artificial Sequence
  Synthetic polynucleotide
ggatgatcacactgactttttttttttttcac

SEQ ID NO: 12154 - DNA, 32 bp, Artificial Sequence
  Synthetic polynucleotide
tgagttttggcatcactgcgccatatttctgg

SEQ ID NO: 12155 - DNA, 32 bp, Artificial Sequence
  Synthetic polynucleotide
ttttttttttttttttcaaccgttacagtttt

SEQ ID NO: 12156 - DNA, 32 bp, Artificial Sequence
  Synthetic polynucleotide
ctgcttattgcccatgagaaagcgctcggttt

SEQ ID NO: 12157 - DNA, 32 bp, Artificial Sequence
  Synthetic polynucleotide
tccccacggtgcagctagtgaagtcataatta

SEQ ID NO: 12158 - DNA, 32 bp, Artificial Sequence
  Synthetic polynucleotide
gctgccaccggtaaccgcgctcagtatggccc

SEQ ID NO: 12159 - DNA, 32 bp, Artificial Sequence
  Synthetic polynucleotide
acgcccaggagtcaatgtcccactaatgtatt

SEQ ID NO: 12160 - DNA, 32 bp, Artificial Sequence
  Synthetic polynucleotide
ttcatccctccagagattgcagaacgactgaa

SEQ ID NO: 12161 - DNA, 32 bp, Artificial Sequence
  Synthetic polynucleotide
ttactgtgcctagcaaaccatatttagttacg

SEQ ID NO: 12162 - DNA, 32 bp, Artificial Sequence
  Synthetic polynucleotide
gtgggtggaatggtaagcaagcccctaacatg

SEQ ID NO: 12163 - DNA, 32 bp, Artificial Sequence
  Synthetic polynucleotide
aggagcactccctagttatgggttactgttga

SEQ ID NO: 12164 - DNA, 32 bp, Artificial Sequence
  Synthetic polynucleotide
tgatcatagtggcacagtatcgccaataggtt

SEQ ID NO: 12165 - DNA, 32 bp, Artificial Sequence
  Synthetic polynucleotide
tcgatggataatacgtatcgccacgcggaaaa

SEQ ID NO: 12166 - DNA, 32 bp, Artificial Sequence
  Synthetic polynucleotide
atatgagggggcactcactgatgttggtagga

SEQ ID NO: 12167 - DNA, 32 bp, Artificial Sequence
  Synthetic polynucleotide
tgttcaggcttgacgaatcctgtttactccat

SEQ ID NO: 12168 - DNA, 32 bp, Artificial Sequence
  Synthetic polynucleotide
tttttttttttttttttattctcgagtttttt

SEQ ID NO: 12169 - DNA, 32 bp, Artificial Sequence
  Synthetic polynucleotide
tgcctaaggaccataggcctagtggtcgccgt

SEQ ID NO: 12170 - DNA, 32 bp, Artificial Sequence
  Synthetic polynucleotide
aaagtcaccctctccctttttttttttttata

SEQ ID NO: 12171 - DNA, 32 bp, Artificial Sequence
  Synthetic polynucleotide
acaaaatcctcgtttttttttttttttttcct

SEQ ID NO: 12172 - DNA, 32 bp, Artificial Sequence
  Synthetic polynucleotide
gttagaaactaacgctcttgcccgattactgg

SEQ ID NO: 12173 - DNA, 32 bp, Artificial Sequence
  Synthetic polynucleotide
ttttttttttttgttacccgtaagctaatttt

SEQ ID NO: 12174 - DNA, 32 bp, Artificial Sequence
  Synthetic polynucleotide
tttttttttttttgcttatccctttggatttt

SEQ ID NO: 12175 - DNA, 32 bp, Artificial Sequence
  Synthetic polynucleotide
tcacgaggctaccgatcgcatccgcttatcgt

SEQ ID NO: 12176 - DNA, 32 bp, Artificial Sequence
  Synthetic polynucleotide
tcgggaaaatcattttttttttttttttgtca

SEQ ID NO: 12177 - DNA, 32 bp, Artificial Sequence
  Synthetic polynucleotide
ctaataactcatttttttttttttttttgtta

SEQ ID NO: 12178 - DNA, 32 bp, Artificial Sequence
  Synthetic polynucleotide
aaatttcgagattcttccaatcgacgagcatc

SEQ ID NO: 12179 - DNA, 32 bp, Artificial Sequence
  Synthetic polynucleotide
ttttttttttttaacaatcatcgtccaatttt

SEQ ID NO: 12180 - DNA, 32 bp, Artificial Sequence
  Synthetic polynucleotide
ttttttttttttccgggcgtcctagttttttt

SEQ ID NO: 12181 - DNA, 32 bp, Artificial Sequence
  Synthetic polynucleotide
acggtgaccctatgtaatcattacaattactg

SEQ ID NO: 12182 - DNA, 32 bp, Artificial Sequence
  Synthetic polynucleotide
ttccttacgtcctttttttttttttttttgag

SEQ ID NO: 12183 - DNA, 32 bp, Artificial Sequence
  Synthetic polynucleotide
agcttctaagctgttcttttttttttttgaac

SEQ ID NO: 12184 - DNA, 32 bp, Artificial Sequence
  Synthetic polynucleotide
gtgacgtccataggtaaggttcacaactctca

SEQ ID NO: 12185 - DNA, 32 bp, Artificial Sequence
  Synthetic polynucleotide
ttttttttttttttttttctgagtttagtttt

SEQ ID NO: 12186 - DNA, 32 bp, Artificial Sequence
  Synthetic polynucleotide
atccgaatgacgaggtttttttttttttctac

SEQ ID NO: 12187 - DNA, 32 bp, Artificial Sequence
  Synthetic polynucleotide
gccgatctcgcccactgcccactgatgtcaag

SEQ ID NO: 12188 - DNA, 32 bp, Artificial Sequence
  Synthetic polynucleotide
ttttttttttttttttgacccgtaagtatttt

SEQ ID NO: 12189 - DNA, 32 bp, Artificial Sequence
  Synthetic polynucleotide
tttttttttttttaaggcccgcctcaggtttt

SEQ ID NO: 12190 - DNA, 32 bp, Artificial Sequence
  Synthetic polynucleotide
tacccacaggtaccatggagctcaatatagca

SEQ ID NO: 12191 - DNA, 32 bp, Artificial Sequence
  Synthetic polynucleotide
tcacttgcacattttttttttttttttttagt

SEQ ID NO: 12192 - DNA, 32 bp, Artificial Sequence
  Synthetic polynucleotide
ctatgaactaacttttttttttttttttttgc

SEQ ID NO: 12193 - DNA, 32 bp, Artificial Sequence
  Synthetic polynucleotide
tggggcaccagccacccagttttaagtatcaa

SEQ ID NO: 12194 - DNA, 32 bp, Artificial Sequence
  Synthetic polynucleotide
ttttttttttttgtaagctgtacctcagtttt

SEQ ID NO: 12195 - DNA, 32 bp, Artificial Sequence
  Synthetic polynucleotide
ttttttttttttggtcttcccctagcaatttt

SEQ ID NO: 12196 - DNA, 32 bp, Artificial Sequence
  Synthetic polynucleotide
ggaagttcagctcaagggtttgatcgaacgac

SEQ ID NO: 12197 - DNA, 32 bp, Artificial Sequence
  Synthetic polynucleotide
tcctatgatcatttttttttttttttttacgc

SEQ ID NO: 12198 - DNA, 32 bp, Artificial Sequence
  Synthetic polynucleotide
tctagcagatcttttttttttttttttttgag

SEQ ID NO: 12199 - DNA, 32 bp, Artificial Sequence
  Synthetic polynucleotide
attgaaaggtgtctgtcgataaccgaggcaca

SEQ ID NO: 12200 - DNA, 32 bp, Artificial Sequence
  Synthetic polynucleotide
ttttttttttttacgataagggttagcttttt

SEQ ID NO: 12201 - DNA, 32 bp, Artificial Sequence
  Synthetic polynucleotide
ttttttttttttttttgaggttagcacttttt

SEQ ID NO: 12202 - DNA, 32 bp, Artificial Sequence
  Synthetic polynucleotide
caagaactggcggtactgggctgacgtgcggc

SEQ ID NO: 12203 - DNA, 32 bp, Artificial Sequence
  Synthetic polynucleotide
caaacattggaatgcattttttttttttatgg

What is claimed is:

1. A three-dimensional nucleic acid structure comprising a plurality of 10 or more single-stranded oligonucleotides, wherein each of the single-stranded oligonucleotides has a length of 28 nucleotides to 36 nucleotides and forms two adjacent antiparallel double helices connected to each other by a single phosphate bond, wherein one of the double helices comprises two adjacent nucleotide domains and the other of the double helices comprises two adjacent nucleotide domains, and each nucleotide domain of a single-stranded oligonucleotide of the plurality is complementary to and binds to a nucleotide domain of another single-stranded oligonucleotide of the plurality to form a 90° dihedral angle.

2. The nucleic acid structure of claim 1, wherein the nucleotide domains of the double helices are of equal nucleotide length.

3. The nucleic acid structure of claim 1, wherein each domain is 8 nucleotides in length.

4. The nucleic acid structure of claim 1, wherein the structure further comprises single-stranded 2-domain oligonucleotides.

5. The nucleic acid structure of claim 1, wherein the oligonucleotides are DNA oligonucleotides.

6. The nucleic acid structure of claim 1, wherein the DNA oligonucleotides are L-DNA oligonucleotides.

7. The nucleic acid structure of claim 1, wherein the single-stranded oligonucleotides of the plurality are cross-linked to each other.

8. The nucleic acid structure of claim 1, wherein the nucleic acid structure comprises 100, 500, or 1000 of the single-stranded oligonucleotides.

9. The nucleic acid structure of claim 1, wherein the structure is a cuboid structure, a cylindrical structure, a sheet, a honeycomb structure, or a hexagonal lattice structure.

10. The nucleic acid structure of claim 1, wherein the structure is a Z-crystal, a ZX-crystal, a Y-crystal, an X-crystal, an XY-crystal, or a ZXY crystal.

11. A method of producing a three-dimensional nucleic acid nanostructure, comprising:
annealing in a vessel a plurality of 10 or more single-stranded oligonucleotides, wherein each of the single-stranded oligonucleotides has a length of 28 nucleotides to 36 nucleotides and forms two adjacent antiparallel double helices connected to each other by a single phosphate bond, wherein one of the double helices comprises two nucleotide domains and the other of the double helices comprises two nucleotide domains, and each nucleotide domain of a single-stranded oligonucleotide of the plurality is complementary to and binds to a nucleotide domain of another single-stranded oligonucleotide of the plurality to form a 90° dihedral angle, thereby producing a three-dimensional nucleic acid nanostructure.

12. The method of claim 11, wherein the single-stranded oligonucleotides are present at equal molar concentrations.

13. The method of claim 11, wherein annealing occurs through a temperature transition over a period of time.

14. The method of claim 13, wherein the temperature transition is a change in temperature from an elevated temperature to room temperature.

15. The method of claim 14, wherein the temperature transition is a change in temperature from 90° C. to room temperature.

16. The method of claim 11, wherein the annealing occurs over a period of 12-24 hours.

17. The method of claim 11, wherein each domain is 8 nucleotides in length.

18. The method of claim 11, wherein the single-stranded oligonucleotides are DNA oligonucleotides.

19. The method of claim 18, wherein the single-stranded DNA oligonucleotides are L-DNA oligonucleotides.

* * * * *